(12) United States Patent
Graham et al.

(10) Patent No.: US 10,898,566 B2
(45) Date of Patent: Jan. 26, 2021

(54) ZIKA VIRUS VACCINES

(71) Applicant: THE USA, AS REPRESENTED BY THE SECRETARY, DEPT. OF HEALTH AND HUMAN SERVICES, Bethesda, MD (US)

(72) Inventors: Barney S. Graham, Rockville, MD (US); Theodore C. Pierson, Poolesville, MD (US); Kimberly A. Dowd, Columbia, MD (US); John R. Mascola, Rockville, MD (US); Wing-pui Kong, Germantown, MD (US); Sung-youl Ko, Gaithersburg, MD (US); Eun Sung Yang, Rockville, MD (US); Wei Shi, Rockville, MD (US); Lingshu Wang, North Potomac, MD (US); Christina R. Demaso, Rockville, MD (US); Rebecca S. Pelc, Morrisville, NC (US); Adrian Creanga, Bethesda, MD (US); Julie Ledgerwood, Bethesda, MD (US); Leda R. Castilho, Rio de Janeiro (BR)

(73) Assignee: The United States of America, as represented by the Secretary, Department of Health and Human Services, Bethesda, MD (US)

( * ) Notice: Subject to any disclaimer, the term of this patent is extended or adjusted under 35 U.S.C. 154(b) by 0 days.

(21) Appl. No.: 16/334,099

(22) PCT Filed: Jul. 28, 2017

(86) PCT No.: PCT/US2017/044468
§ 371 (c)(1),
(2) Date: Mar. 18, 2019

(87) PCT Pub. No.: WO2018/052549
PCT Pub. Date: Mar. 22, 2018

(65) Prior Publication Data
US 2019/0374633 A1 Dec. 12, 2019

Related U.S. Application Data

(60) Provisional application No. 62/396,613, filed on Sep. 19, 2016.

(51) Int. Cl.
| | |
|---|---|
| *A61K 39/12* | (2006.01) |
| *A61K 39/00* | (2006.01) |
| *A61K 39/015* | (2006.01) |
| *C12N 7/00* | (2006.01) |
| *A61K 39/295* | (2006.01) |
| *C07K 14/005* | (2006.01) |
| *G01N 33/536* | (2006.01) |
| *G01N 33/569* | (2006.01) |

(52) U.S. Cl.
CPC ............ *A61K 39/12* (2013.01); *C07K 14/005* (2013.01); *G01N 33/536* (2013.01); *G01N 33/56983* (2013.01); *A61K 2039/5258* (2013.01); *A61K 2039/53* (2013.01); *C07K 2319/02* (2013.01); *C07K 2319/33* (2013.01); *C12N 2770/24122* (2013.01); *C12N 2770/24123* (2013.01); *C12N 2770/24134* (2013.01); *C12N 2770/24143* (2013.01); *C12N 2770/24151* (2013.01); *C12N 2770/24171* (2013.01)

(58) Field of Classification Search
CPC ............ A61K 39/12; A61K 2039/5254; A61K 2039/575; C12N 2770/24134; Y02A 50/386
See application file for complete search history.

(56) References Cited

U.S. PATENT DOCUMENTS

| | | | |
|---|---|---|---|
| 7,227,011 | B2 | 6/2007 | Chang |
| 7,521,177 | B2 | 4/2009 | Chang |
| 7,632,510 | B2 | 12/2009 | Chang |
| 7,662,394 | B2 | 2/2010 | Chang |
| 7,906,292 | B2 | 3/2011 | Chang et al. |
| 8,105,609 | B2 | 1/2012 | Chang |
| 8,221,768 | B2 | 7/2012 | Chang |
| 8,232,379 | B2 | 7/2012 | Chang |
| 8,728,488 | B2 | 5/2014 | Chang |

OTHER PUBLICATIONS

Larocca et al., "Vaccine protection against zika virus from brazil", Nature, 2016, 536(7617):474-478.*
Larocca et al., Nature, 2016,536(7617):474-478.*
Williams, Vaccines, 2013, 1:225-249.*
International Search Report prepared by the European Patent Office dated Oct. 17, 2017, for International Application No. PCT/US2017/044468.
Written Opinion prepared by the European Patent Office dated Oct. 17, 2017, for International Application No. PCT/US2017/044468.
Cohen "The race fora Zika vaccine is on," Science, Feb. 2016, vol. 351, No. 6273, pp. 543-544.
Dowd et al. "Rapid development of a DNA vaccine for Zika virus," Science, Oct. 2016, vol. 354, No. 6309, pp. 237-240.
Dowd et al. "Supplementary Materials for: Rapid development of a DNA vaccine for Zika virus," Science, Oct. 2016, vol. 354, No. 6309, pp. 237-240, Materials and Methods, Figs. S1-S8, Table S1 and References, 19 pages.

(Continued)

*Primary Examiner* — Barry A Chestnut
(74) *Attorney, Agent, or Firm* — Klarquist Sparkman, LLP

(57) ABSTRACT

The present invention relates to a vaccine for Zika virus, the vaccine comprising Zika virus membrane and envelope proteins. More specifically, the vaccine comprises nucleic acid molecules encoding modified Zika virus membrane and/or envelope proteins. When introduced into a cell, the encoded proteins are produced, which results in the production of a virus-like particle capable of eliciting an immune response against Zika virus.

20 Claims, 45 Drawing Sheets

Figure 1A:
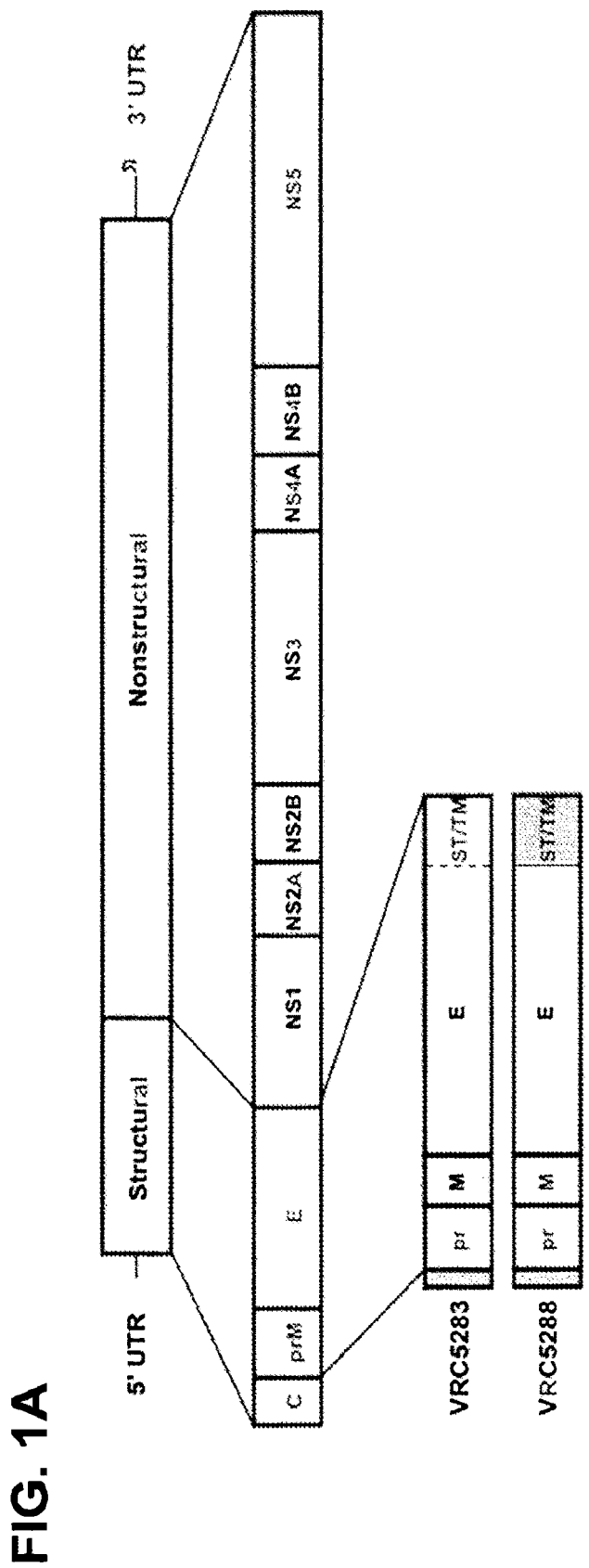

Specification includes a Sequence Listing.

(56) References Cited

OTHER PUBLICATIONS

Larocca et al. "Vaccine protection against Zika virus from Brazil," Nature, Jun. 2016, vol. 536, No. 7617, pp. 474-478.
Lee et al. "Mutagenesis of the Signal Sequence of Yellow Fever Virus prM Protein: Enhancement of Signalase Cleavage in Vitro Is Lethal for Virus Production," Journal of Virology, Jan. 2000, vol. 74, No. 1, pp. 24-32.
Williams "Vector Design for Improved DNA Vaccine Efficacy, Safety and Production," Vaccines, Jun. 2013, vol. 1, No. 3, pp. 225-249.
International Preliminary Report on Patentability for International (PCT) Patent Application No. PCT/US2017/044468, dated Mar. 28, 2019 7 pages.
International Search Report and Written Opinion for International (PCT) Patent Application No. PCT/US2018/018809, dated Jul. 2, 2018 17 pages.

\* cited by examiner

VRC8400  VRC5288

Week Post-Vaccination

FIG. 7B

Figure 12

| Group | Subjects* | Day 0 | Week 4 | Week 8 | Week 12 | Week 20 |
|---|---|---|---|---|---|---|
| 1 | 20 | X | | X | | |
| 2 | 20 | X | | | X | |
| 3 | 20 | X | X | X | | |
| 4 | 20 | X | X | | | X |
| Total | 80 | | | | | |

All injections are ZIKV DNA vaccine, 4 mg/mL

Figure 14

VRC 319
Neutralizing Antibody Response 4 weeks after Last Vaccination

| Group | Number of Vaccinations | Week of Vaccination | Response Frequency | Median Titer of Responders | Geometric Mean Titer of Responders | Titer Range of Responders |
|---|---|---|---|---|---|---|
| 1 | 2 | 0,8 | 12/20 (60%) | 162 | 68 | 60-403 |
| 2 | 2 | 0,12 | 15/20 (75%) | 81 | 74 | 33-400 |
| 3 | 3 | 0,4,8 | 16/20 (80%) | 102 | 110 | 35-719 |
| 4 | 3 | 0,4,20 | 17/20 (85%) | 142 | 108 | 43-847 |

Responder = EC50 Value over 30

Figure 15

VRC 320 Study Schema

| Group | Administration Method | N | Administration Schedule Day 0 | Week 4 | Week 8 |
|---|---|---|---|---|---|
| 1 | Single Dose N/S | 15 | ZIKV DNA (4mg, 1 injection of 1mL) | ZIKV DNA (4mg, 1 injection of 1mL) | ZIKV DNA (4mg, 1 injection of 1mL) |
| 2 | Split Dose N/S | 15 | ZIKV DNA (4mg, 2 injections of 0.5 mL) | ZIKV DNA (4mg, 2 injections of 0.5 mL) | ZIKV DNA (4mg, 2 injections of 0.5 mL) |
| 3 | Split Dose PharmaJet | 15 | ZIKV DNA (4mg, 2 injections of 0.5 mL) | ZIKV DNA (4mg, 2 injections of 0.5 mL) | ZIKV DNA (4mg, 2 injections of 0.5 mL) |
| | Total | 45 | | | |

FIG. 17B

VRC320
4 weeks Post Last Vaccination

| Group | 1<br>N/S | 2<br>N/S, Split | 3<br>PharmaJet, Split |
|---|---|---|---|
| Response Rate (EC50 over 30) | 8/11* (73%) | 11/12 (92%) | 11/11* (100%) |
| Geometric Mean EC50 | 43 | 135 | 281 |
| Median EC50 | 42 | 160 | 272 |

ZIKA VIRUS VACCINES

CROSS REFERENCE TO RELATED APPLICATIONS

This application is a national stage application under 35 U.S.C. 371 and claims the benefit of PCT Application No. PCT/US2017/044468 having an international filing date of 28 Jul. 2017, which designated the United States, which PCT application claimed the benefit of U.S. Provisional Application No. 62/396,613 filed 19 Sep. 2016, the disclosure of each of which are incorporated herein by reference.

REFERENCE TO SEQUENCE LISTING

This application contains a Sequence Listing submitted as an electronic text file named "6137NIAID-63-PROV_Sequence_Listing_ST25.txt", having a size in bytes of 1822 KB, and created on Sep. 19, 2016. The information contained in this electronic file is hereby incorporated by reference in its entirety pursuant to 37 CFR § 1.52(e)(5).

FIELD OF TECHNOLOGY

The present invention relates to vaccines for immunizing individuals against Zika virus. More specifically, the present invention relates to the use of Zika virus proteins, nucleic acid molecule encoding such proteins, and VLPs made from such proteins to elicit a protective immune response against Zika virus.

BACKGROUND

Zika virus (ZIKV) is a mosquito-transmitted flavivirus that has emerged from relative obscurity to cause an epidemic of great public health concern. During the half-century that followed its discovery in Uganda in 1947, Zika virus was rarely linked to disease in humans, despite considerable transmission. The emergence of a Zika virus epidemic was first reported in Yap island in 2007, followed by outbreaks in French Polynesia in 2013 and 2014, and regularly thereafter in other islands of the Pacific. The introduction of Zika virus into the Western Hemisphere occurred in 2014-2015 in Haiti and Brazil and spread rapidly to 33 or more countries. Historically, symptomatic Zika virus infection of humans was described as a self-limiting mild febrile illness associated with rash, arthralgia, and conjunctivitis. However, recent Zika virus infection has also been associated with neurological complications, including Guillain-Barré syndrome and meningoencephalitis. Of significant concern, Zika virus infection is now strongly linked to microcephaly and intrauterine growth retardation in the fetuses of women infected with the virus while pregnant. This association has recently been confirmed in murine models of Zika virus.

Flaviviruses are spherical virus particles that incorporate two structural proteins into their lipid envelope, precursor to membrane/membrane (prM/M) and envelope (E). Virions assemble on membranes of the endoplasmic reticulum as non-infectious immature virus particles that incorporate prM and E as heterotrimeric spikes arranged with icosahedral symmetry. In this configuration, E proteins are incapable of low pH-triggered conformational changes required to drive membrane fusion following virus entry (Heinz et al., 1994). During transit through the secretory pathway, prM is cleaved by a cellular furin-like protease, resulting in the formation of an infectious mature virion that retains only the short M peptide. The high-resolution structure of the mature Zika virus virion and the ectodomain of the E protein have been solved. Similar to other flaviviruses, mature Zika virus virions are relatively smooth particles that incorporate 180 copies each of the E and cleaved M proteins. The E protein is arranged on mature virions as antiparallel dimers that lie relatively flat against the lipid envelope in a herringbone pattern. Each E protein is composed of three structural domains connected by flexible linkers and is anchored to the viral membrane by a helical structure and two antiparallel transmembrane domains.

The capsid (C) protein, at the amino terminus of the polyprotein, is separated from the prM protein by a signal sequence directing the translocation of prM. The NS2B-3 protease complex catalyzes cleavage at the carboxy terminus of the C protein on the cytoplasmic side of the ER membrane. This is the only site in the structural polyprotein region which is cleaved by this enzyme. The type I transmembrane protein prM is anchored in the lipid bilayer by a carboxy terminus membrane anchor, which is immediately followed by the signal sequence for translocation of the E protein, also a type I transmembrane protein. Thus the amino terminus of the prM and E proteins are generated by signal peptidase cleavages. However, it has been noted for a number of flaviviruses that when the entire structural polyprotein region is expressed from cDNA, the signal peptidase-mediated cleavage at the amino terminus of prM does not occur efficiently, in contrast to that at the amino terminus of the E protein. This inefficient production of prM is reflected in the deficiency of secretion of the prM-E heterodimer and, in turn, the lack of immunogenicity often observed when such constructs are used for vaccination.

Neutralizing antibodies play a critical role in protection against flavivirus infection and disease. All three E protein domains contain epitopes recognized by neutralizing antibodies. Additionally, potent neutralizing antibodies have been isolated that bind surfaces composed of more than one domain or E protein. These quaternary epitopes have been identified as components of the neutralizing antibody response to dengue (DENV), yellow fever (YFV), West Nile (WNV), and tick-borne encephalitis (TBEV) viruses. Antibodies that bind prM have been isolated from infected humans, but show limited neutralizing capabilities in vitro. Because neutralizing antibody titers correlate with protection by vaccines for Japanese encephalitis virus (JEV), YFV, and TBEV, eliciting neutralizing antibodies is a desired feature of candidate vaccines for related flaviviruses, including Zika virus.

Flaviviruses circulate as genetically distinct genotypes or lineages, in part due to the high error rate associated with RNA virus replication. Zika virus strains have been grouped into two lineages, African and Asian, which differ by <5% at the amino acid level. The African lineage includes the historical MR-766 strain originally identified in 1947, whereas virus strains from the Asian lineage have been attributed to the recent outbreaks in Yap, French Polynesia, and the Americas. Understanding how sequence variation among Zika virus strains impacts antibody recognition is of particular importance to vaccine development. DENV, for example, circulates as four distinct serotypes that differ by 25-40% at the amino acid level. The challenges of eliciting a protective neutralizing antibody response against all four DENV serotypes has hampered delayed vaccine development. Desirable Zika vaccine candidates should provide equivalent protection against both Asian and African lineages. Previous attempts at producing such a vaccine have been made, and suck work is disclosed, for example, in U.S.

Pat. Nos. 7,227,011; 7,417,136; 7,662,394; 8,109,609; US2014/0335117; and US2015/0246951, all of which are incorporated herein by reference in their entirety. However, there remains a need for a safe and effective vaccine against flaviviruses, and Zika virus in particular. The present disclosure satisfies this need and provides additional benefits as well.

SUMMARY

This disclosure provides nucleic acid molecules encoding a polyprotein, which comprises at least a portion of a Zika virus prM protein joined to at least a portion of a Zika virus E protein, and wherein the at least a portion of a Zika virus prM protein comprises a signal sequence that is heterologous to Zika virus. These nucleic acid molecules may be operatively linked to a control sequence. The control sequence may include a promoter that drives expression of the nucleic acid sequence. The expression of these polyproteins in a cell results in production of a virus-like particle (VLP). These VLP are capable of eliciting an immune response against Zika virus.

In these nucleic acid molecules, the heterologous signal sequence may be, for example, human CD5, mouse IL-2, bovine prolactin, or a flavivirus structural protein. If from a flavivirus protein, the heterologous signal sequence may be from a flavivirus prM protein. These flavivirus proteins may be from yellow fever virus, Dengue virus, Japanese encephalitis virus, or West Nile Virus. The heterologous signal sequence may be encoded by a nucleic acid sequence at least 80%, at least 85%, at least 90%, at least 95%, or at least 97% identical to, or comprises SEQ ID NO:17, SEQ ID NO:19, SEQ ID NO:23, or SEQ ID NO:25. Alternatively or additionally, the heterologous signal sequence may comprise an amino acid sequence at least 80%, at least 85%, at least 90%, at least 95%, or at least 97% identical to, or comprises SEQ ID NO:18, SEQ ID NO:20, SEQ ID NO:24, or SEQ ID NO:26.

In these nucleic acid molecules, the Zika virus prM protein may be encoded by a nucleic acid molecule comprising a nucleic acid sequence at least 80%, at least 85%, at least 90%, at least 95%, at least 97%, or 100% identical to SEQ ID NO:1. Alternatively or additionally, the Zika virus prM protein may be encoded by a polynucleotide comprising a sequence selected from the group consisting of SEQ ID NO:240-SEQ ID NO:450. Alternatively, or additionally, the Zika virus prM protein may comprise an amino acid sequence at least 80%, at least 85%, at least 90%, at least 95%, at least 97%, or 100% identical to SEQ ID NO:2. Alternatively or additionally, the Zika virus prM protein may comprise an amino acid sequence at least 80%, at least 85%, at least 90%, at least 95%, at least 97%, or 100% identical to the sequence of a modified protein listed in Table 3. Alternatively, or additionally, the Zika virus prM protein may comprise an amino acid sequence at least 80%, at least 85%, at least 90%, at least 95%, at least 97%, or 100% identical to the sequence of a modified protein listed in Table 3, and wherein the prM protein comprises at least one mutation from the modified protein listed in Table 3. Alternatively, or additionally, the Zika virus prM protein comprises an amino acid sequence at least 80%, at least 85%, at least 90%, at least 95%, or at least 97% identical to a protein sequence selected from the group consisting of SEQ ID NOs:29-239, and wherein the prM protein comprises at least one mutation from the protein sequence selected from the group consisting of SEQ ID NO:29-SEQ ID NO:239. Alternatively, or additionally, the Zika virus prM protein may comprise an amino acid sequence at least 80%, at least 85%, at least 90%, at least 95%, at least 97%, or 100% identical to SEQ ID NO:4.

In these nucleic acid molecules, the Zika virus envelope (E) protein may be encoded by a nucleic acid molecule comprising a nucleic acid sequence at least 80%, at least 85%, at least 90%, at least 95%, at least 97%, or 100% identical to SEQ ID NO:3. Alternatively or additionally, the Zika virus envelope protein may be encoded by a nucleic acid molecule listed in Table 3. Alternatively or additionally, the Zika virus envelope protein may be encoded by a nucleic acid molecule comprising a sequence selected from the group consisting of SEQ ID NO:240-SEQ ID NO:450. Alternatively, or additionally, the Zika virus envelope protein may comprise an amino acid sequence at least 80%, at least 85%, at least 90%, at least 95%, at least 97%, or 100% identical to SEQ ID NO:4. Alternatively, or additionally, the Zika virus envelope protein in these nucleic acids may be modified by substituting the stem region and/or the transmembrane region with a corresponding region from the envelope protein of a different flavivirus. Both the stem region and the transmembrane region may be replaced with the corresponding region of an envelope protein from a different flavivirus, such as, for example, yellow fever virus, Dengue virus, Japanese encephalitis virus and West Nile Virus. Alternatively, or additionally, the Zika virus envelope protein comprises at least one mutation that stabilizes a VLP comprising the envelope protein. Alternatively, or additionally, the Zika virus envelope protein may comprise at least one mutation that enhances the immunogenicity of a VLP comprising the envelope protein. Alternatively, or additionally, the envelope protein may comprise at least one mutation in at least one of the fusion peptide, the fusion loop, the M loop, and the be loop region. These mutations may be at any amino acid position corresponding to a location selected from the group consisting of R2, G5, N8, S16, G28, A54, T76, Q77, D87, W101, G106, L107, N134, T160, T170, E177, R193, P222, W225, T231, K251, Q253, V255, V256, V257, Q261, E262, H266, E262, D296, K297, L300, S304, Y305, L307, K316, and E320, of SEQ ID NO:4. Alternatively or additionally, the Zika virus envelope protein may comprise an amino acid sequence at least 80%, at least 85%, at least 90%, at least 95%, at least 97%, or 100% identical to the sequence of a modified protein listed in Table 3, wherein the envelope protein comprises at least one mutation from the modified protein listed in Table 3. Alternatively, or additionally, the Zika virus envelope protein may comprise a protein encoded by a nucleic acid molecule listed in Table 3. Alternatively, or additionally, the Zika virus envelope protein may comprise an amino acid sequence at least 80%, at least 85%, at least 90%, at least 95%, at least 97%, or 100% identical to a sequence selected from the group consisting of SEQ ID NO:29-239, and wherein the Zika virus envelope protein comprises at least one mutation from the sequence selected from the group consisting of SEQ ID NOs:29-239.

This disclosure also provides cells comprising any one of these nucleic acid molecules. This disclosure also provides methods of producing a Zika virus-like particles, by introducing into a cell any one of these nucleic acid molecules such that the encoded fusion protein is expressed.

Thus, this disclosure also provides a protein encoded by these nucleic acid molecules. These proteins may comprise an amino acid sequence at least 80%, at least 85%, at least 90%, at least 95%, at least 97%, or 100% identical to a polypeptide sequence listed in Table 3, wherein the protein comprises at least one mutation from the polypeptide sequence listed in Table 3. Alternatively, or additionally, these proteins may comprise an amino acid sequence at least 80%, at least 85%, at least 90%, at least 95%, at least 97%, or 100% identical to a sequence selected from the group consisting of SEQ ID NOs:29-239, wherein the protein comprises at least one mutation from the sequence selected from the group consisting of SEQ ID NO:29-239.

This disclosure also provides A virus-like particle comprising a protein encoded by these nucleic acid molecules or proteins that is capable of inducing an immune response to Zika virus. Similarly, this disclosure encompasses a composition comprising any one of these nucleic acid molecule or proteins or VLPs, and a pharmaceutically acceptable carrier.

This disclosure also provides methods of eliciting an immune response against Zika virus in an individual, by administering at least one of these nucleic acid molecules, or proteins or VLPs, or compositions to the individual. Similarly, this disclosure provides methods of immunizing an individual against Zika virus, by administering at least one of these nucleic acid molecules, or proteins or VLPs, or compositions to the individual.

An exemplary embodiment of this disclosure is a nucleic acid molecule comprising a nucleotide sequence encoding a polyprotein comprising the Japanese Encephalitis Virus envelope protein signal sequence joined to a protein comprising Zika virus prM protein, which is joined to a modified Zika virus envelope protein. The stem and transmembrane region of this modified Zika virus envelope protein are from the envelope protein of Japanese Encephalitis virus, and the modified envelope protein optionally comprises at least one mutation from a protein sequence listed in Table 3. In this nucleic acid molecule, the polyprotein may comprise an amino acid sequence at least 80%, at least 85%, at least 90%, at least 95%, at least 97%, or 100% identical to a polypeptide sequence listed in Table 3, wherein the protein maintains the at least one mutation from the polypeptide listed in Table 3. In these nucleic acid molecules, the polyprotein may comprise an amino acid sequence at least 80%, at least 85%, at least 90%, at least 95%, at least 97%, or 100% identical to a sequence selected from SEQ ID NOs:29-239, wherein the protein maintains the at least one mutation from the sequence selected from the group consisting of SEQ ID NOs:29-239. Thus, this disclosure provides a VLP comprising a protein encoded by any one of these nucleic acid molecules.

This disclosure also provides a method of detecting anti-Zika virus antibodies in a sample, by contacting at least a portion of the sample with a VLP of this disclosure under conditions suitable for forming a VLP-antibody complex, and then detecting the presence of the VLP-antibody complex, if present. The presence of the VLP-antibody complex indicates the presence of anti-Zika virus antibodies in the sample.

This disclosure also provides a method of detecting anti-Zika antibodies is a sample by exposing a RVP of this disclosure to at least a portion of the sample, contacting the sample exposed RVP to permissive cells, and then analyzing the presence of a reporter molecule encoded by the RVP, wherein the absence, or a reduction in, of reporter molecule in the permissive cell relative to a control sample, indicates the presence of anti-Zika virus antibodies in the sample.

BRIEF DESCRIPTION OF THE FIGURES

FIGS. 1A-1D describe the ZIKAV DNA vaccine design and characterization. FIG. 1A is a schematic representation of the ZIKAV genome and ZIKAV DNA vaccine constructs VRC5283 and VRC5288. The ZIKV genome encodes the structural proteins capsid (C), pre-membrane (prM) and envelope (E), and nonstructural proteins NS1, NS2A, NS2B, NS3, NS4A, NS4B and NS5 expressed as a single polyprotein that is cleaved by host cell proteases into individual proteins. The codon-modified prM-E gene from ZIKV strain H/PF/2013 (GenBank accession AHZ13508.1) was inserted into a mammalian expression vector (VRC8400) downstream of a signal sequence derived from Japanese encephalitis virus (JEV) (GenBank accession ADZ48450.1), and named VRC5283. VRC5283 was further modified to create VRC5288 by swapping the stem and transmembrane (ST/TM) regions of ZIKV E with the analogous sequence from JEV. FIG. 1B shows the expression and secretion of ZIKV E analyzed by Western blot of transfected 293T cell lysates and SVP precipitate pelleted from culture supernatants through a 20% sucrose cushion demonstrating that the VRC5288 construct secretes more particles than VRC5283. FIG. 1C shows the results of a particle-capture ELISA quantifying the secretion of ZIKV SVP from transfected cells and demonstrates roughly 10-fold greater particle release from VRC5288- than VRC5283-transfected cells (endpoint titers of 1:274 and 1:24, respectively). FIG. 1D shows electron micrographs of ZIKV subviral particles (SVP) purified from the culture supernatant of VRC5288-transfected 293-F cells and subjected to negative staining and electron microscopy. SVP are labeled with arrowheads. The VRC8400 empty backbone plasmid vector was used as a control.

FIGS. 2A-2L demonstrate that ZIKV DNA vaccines elicit robust binding and neutralizing antibodies in nonhuman primates. Rhesus macaques (n=6/group) were either mock immunized with VRC8400 empty backbone expression plasmid or with VRC5283 or VRC5288 vaccine plasmids. The VRC8400, VRC5283, and VRC5288 recipients were injected with 4 mg doses at weeks 0 and 4. Other VRC5283 recipients were injected with 1 mg at weeks 0 and 4, and a group of VRC5288 recipients were injected once with 1 mg. All injections were given intramuscularly. Arrows indicate vaccination time points. FIGS. 2A-2E show macaque sera assayed weekly for ZIKV binding antibodies by ELISA. Each line represents an individual animal and dashed line indicates the limit of detection (reciprocal titer of 64). Any measurement below the limit of detection was assigned a value of half the limit of detection for graphing and statistical purposes. FIGS. 2F-2J show the NAb response elicited by vaccination analyzed using ZIKV reporter virus particles (RVPs). RVPs were produced by complementation of a GFP-expressing WNV replicon with a plasmid encoding the structural genes (C-prM-E) of ZIKV strain H/PF/2013. RVPs were mixed with serial three-fold dilutions of serum for 1 h at 37° C. prior to being added to Raji-DCSIGNR cells. After 48 h, GFP-expressing infected cells were quantitated by flow cytometry. The dilution of sera required for half-maximal inhibition of virus infection ($EC_{50}$) was estimated by non-linear regression analysis. Lines connect the average $EC_{50}$ values of 2-5 independent experiments, each performed with duplicate technical replicates, for the individual monkeys in each group, at each timepoint. Error bars denote the standard error of mean. The dotted line denotes the limit of confidence for the RVP assay (reciprocal titer of 60). Measurements below the limit of detection were assigned a value of 30. The average binding antibody (FIG. 2K) and NAb (FIG. 2L) responses for each vaccine group are shown. Error bars denote the standard error of the mean.

Figure 3A:
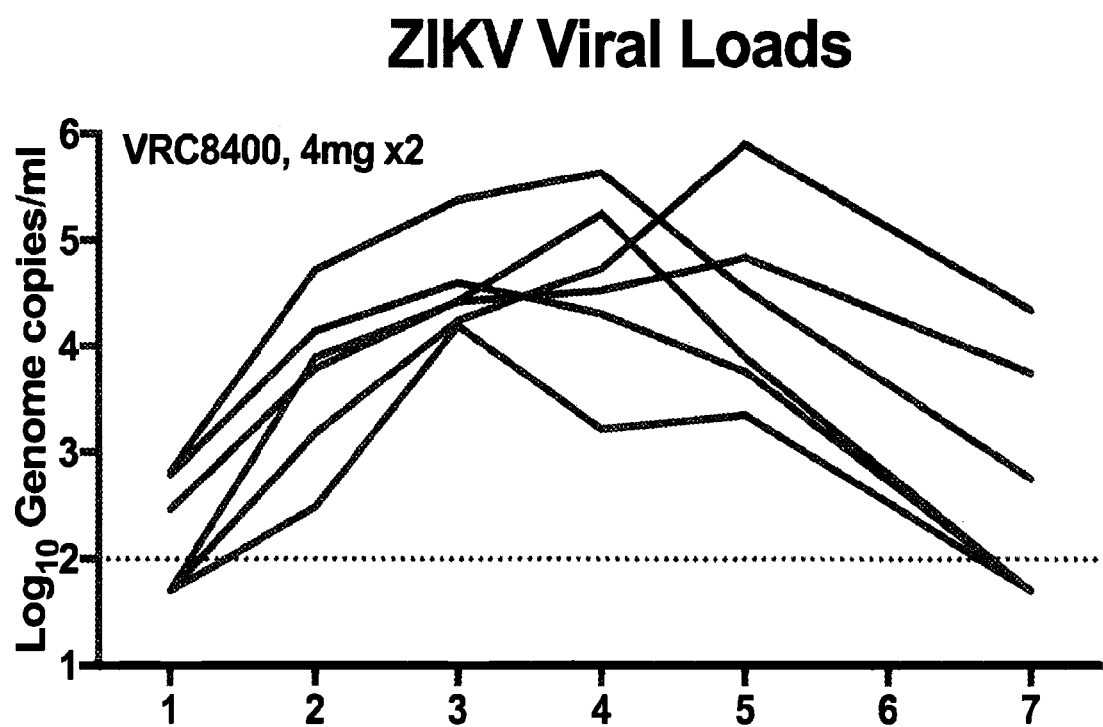
Figure 3B:
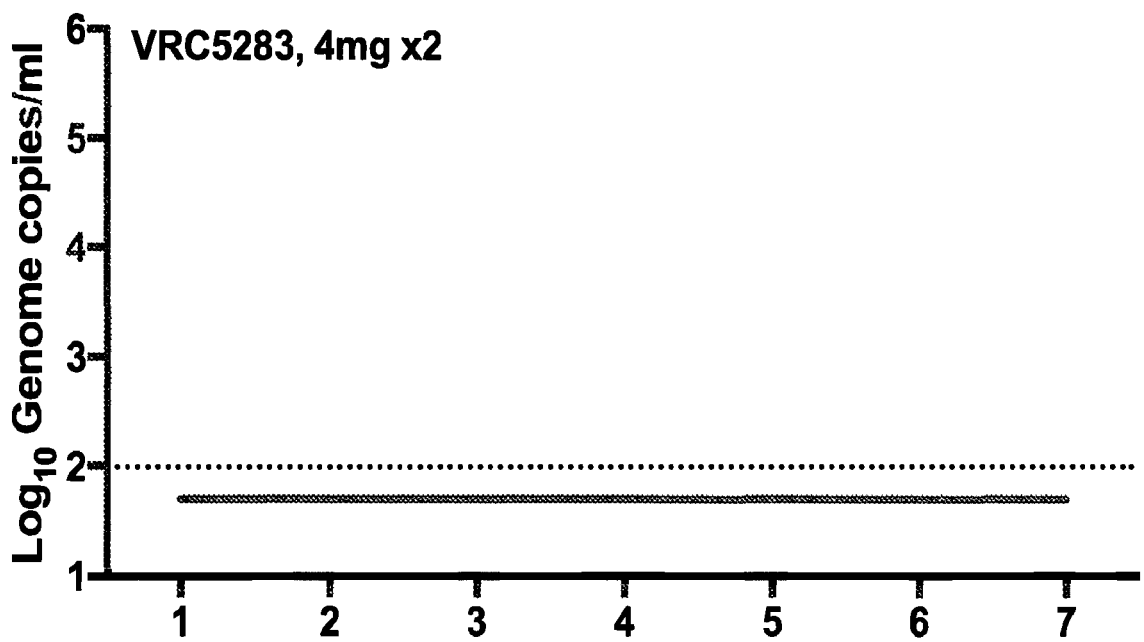
Figure 3C:
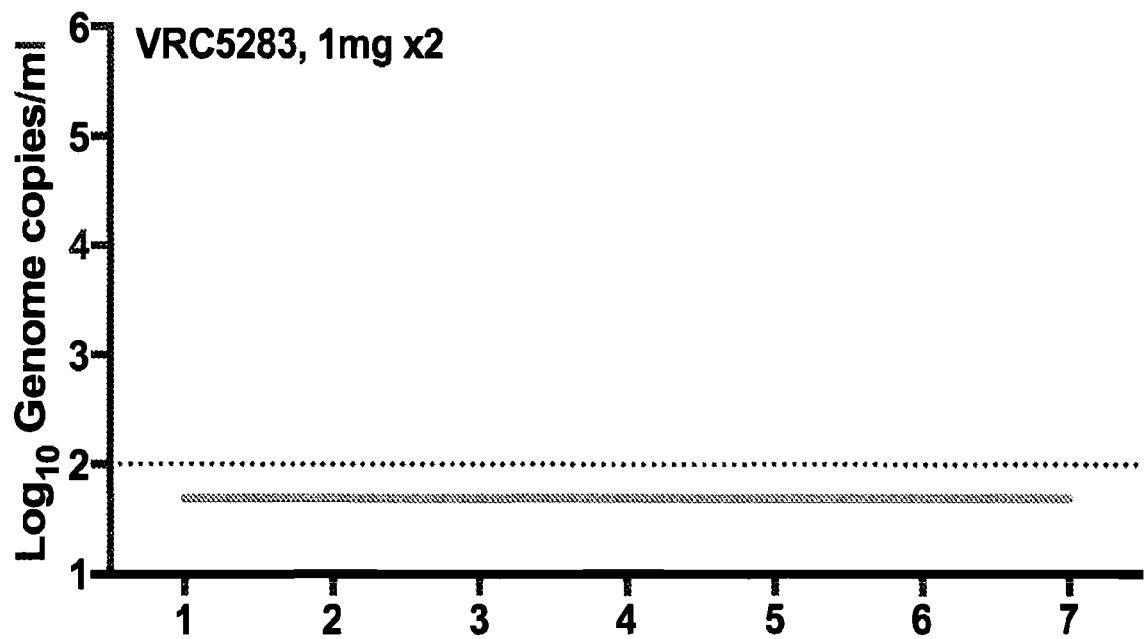
Figure 3D:
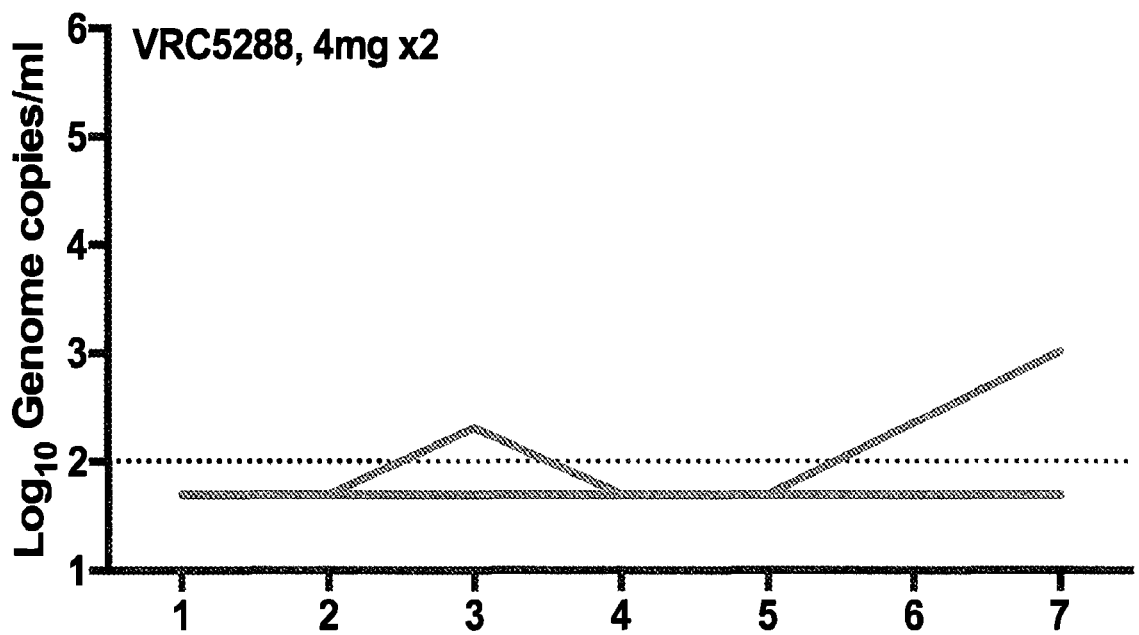
Figure 3E:
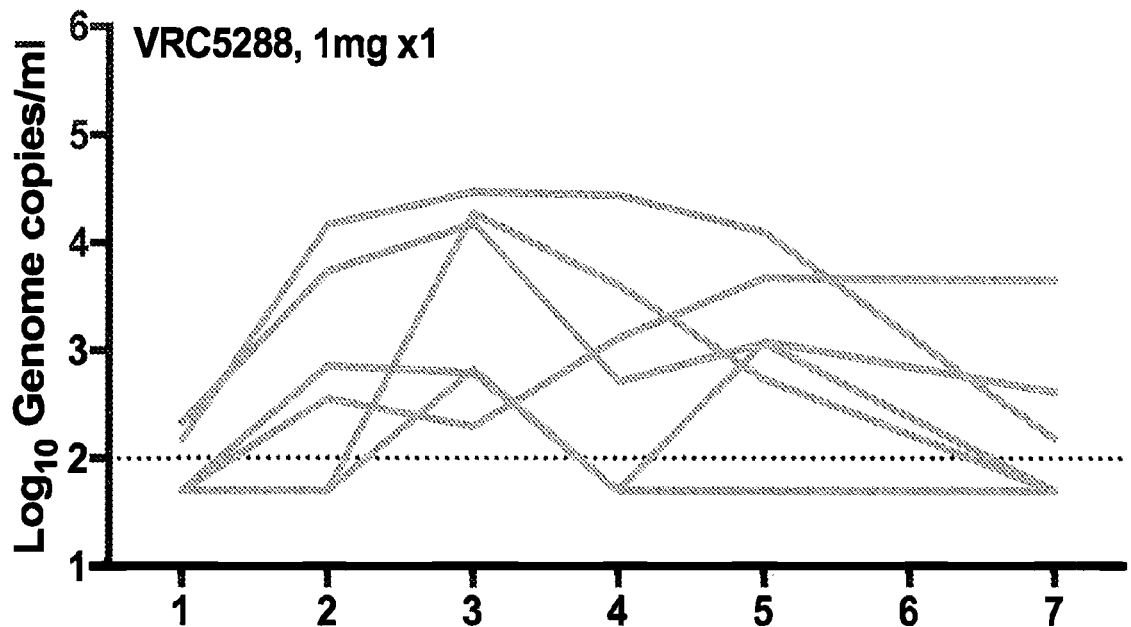
Figure 3F:
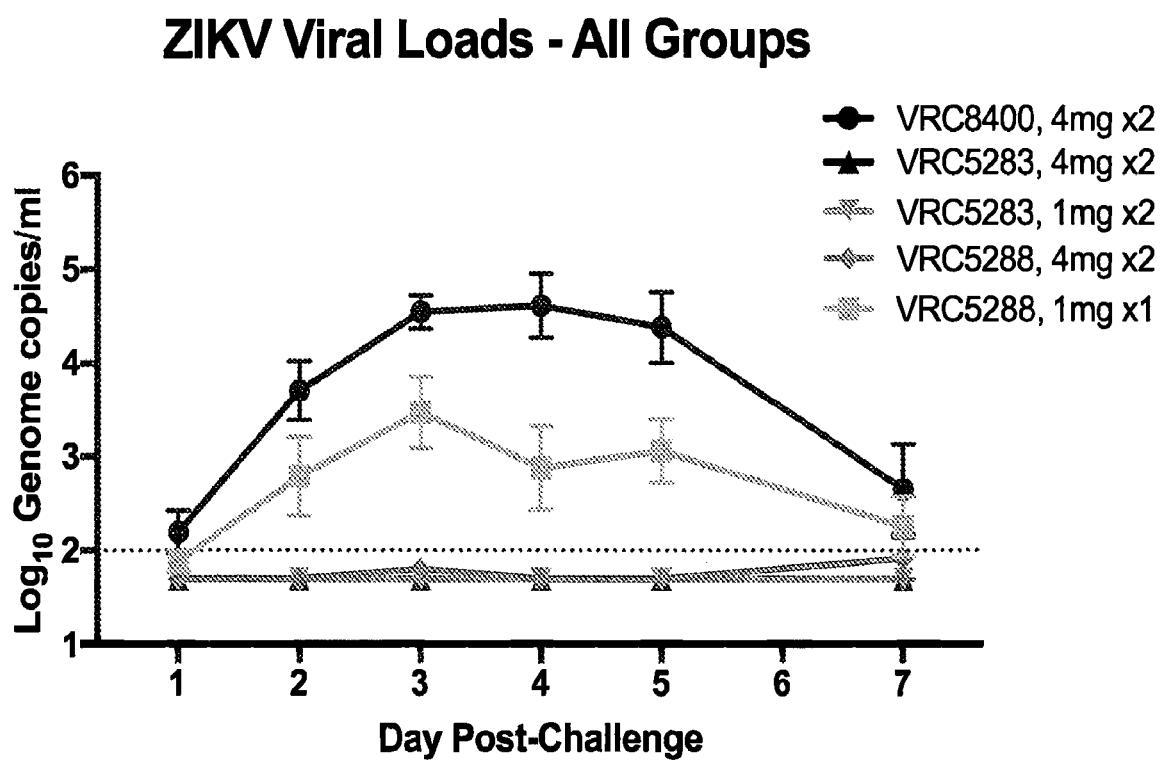

FIGS. 3A-3F demonstrate that ZIKV DNA vaccines reduce viremia in ZIKV-challenged rhesus macaques. Eight weeks after the first vaccination, macaques were challenged with 1000 FFU of ZIKV PRVABC59. FIGS. 3A-3E show the results of qPCR of the capsid gene as used to determine the genome copies/ml on days 1-5 and 7 post-challenge. Each line represents an individual animal. FIG. 3F shows the mean viral load after challenge in each group. Error bars represent the standard error of the mean. Viral load in recipients of one dose of 1 mg VRC5288 was significantly reduced compared to viremia in mock-immunized VRC8400 recipients when comparing area under the curve (AUC) of viral load trajectories by Wilcoxon Exact Test (two-sided p=0.041). Dashed line indicates the limit of detection (100 copies/ml). Any value below the limit of detection was assigned a value half the limit of detection for graphing and AUC calculation.

Figure 4B:
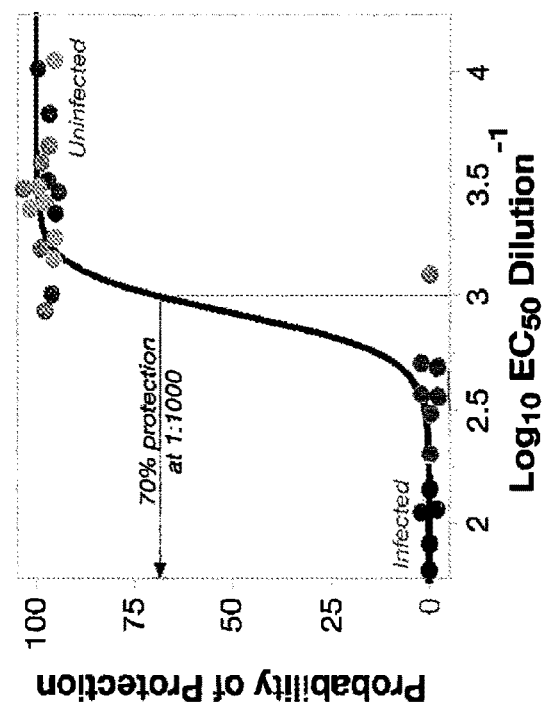
Figure 4A:
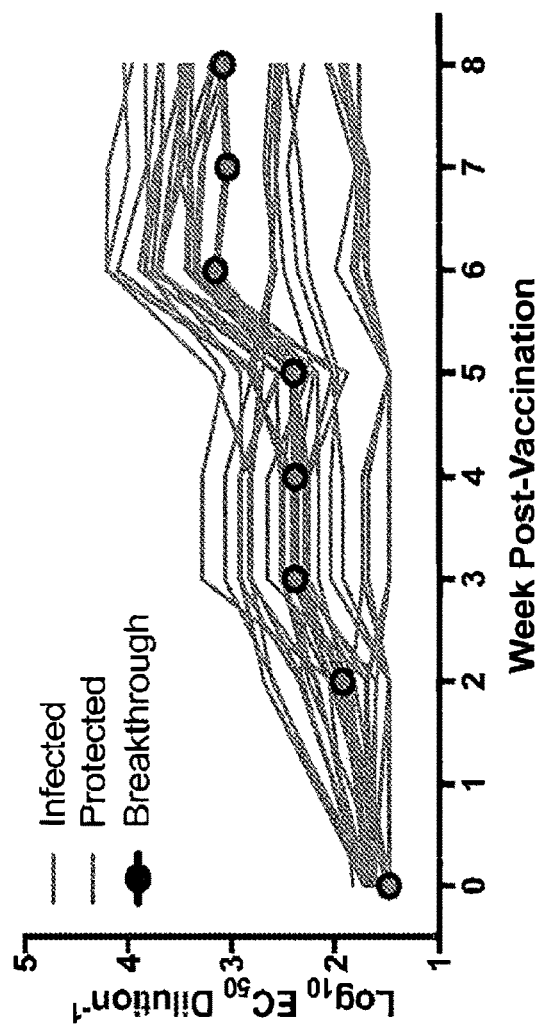
Figure 4C:
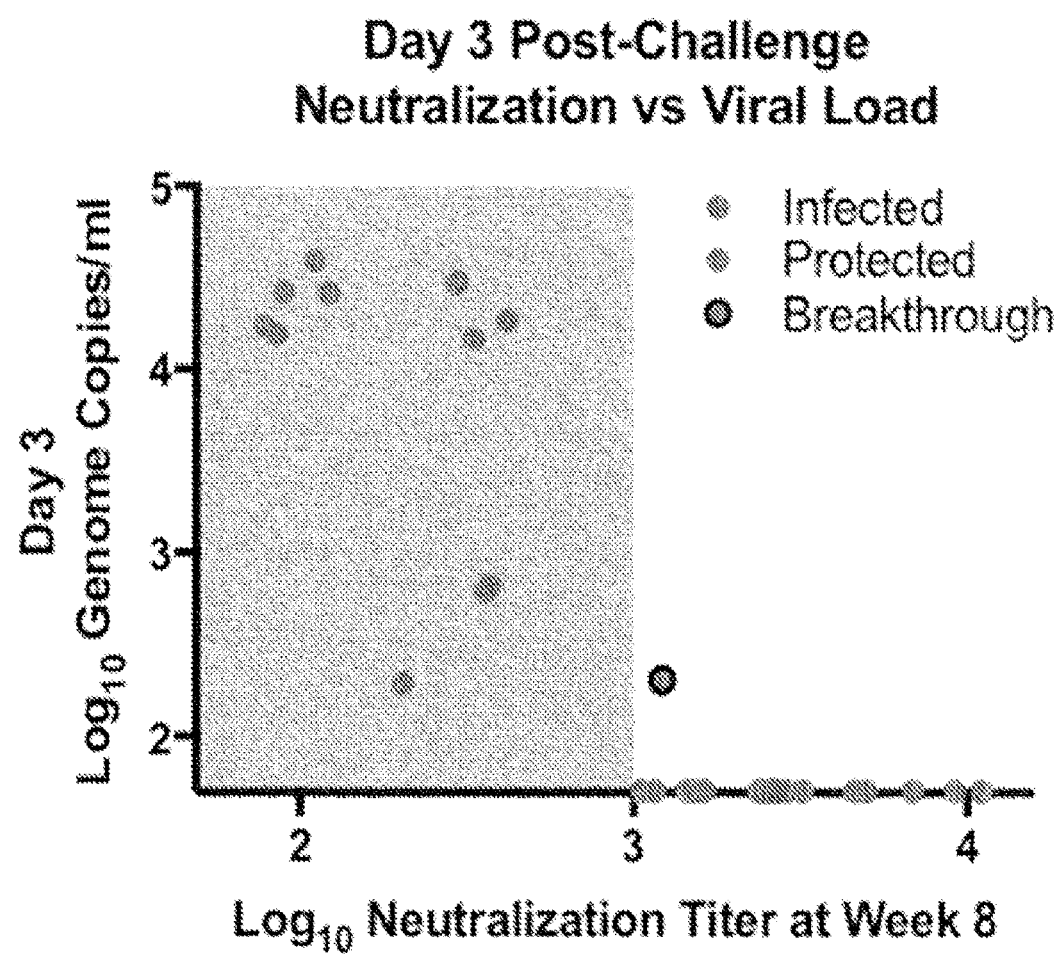

FIGS. 4A-4C show that the protection from ZIKV challenge correlates with NAb titers present at challenge. Animals that had detectable viremia post-challenge were analyzed with respect to pre-challenge NAb activity. FIG. 4A is the reciprocal $EC_{50}$ NAb titer of each animal individually plotted to reflect whether infection occurred or not. Lines indicate individual animals. Protected (no detectable viremia) and infected (viremia detectable on two successive days) animals are represented by gray and red lines, respectively. The sole animal that received two 4 mg doses of VRC5288 and was found to have a low level of viremia on days 3 and 7 after challenge is denoted as "breakthrough" (black outlined dots). That animal had the lowest prechallenge NAb titer of any recipient of two vaccine doses. The two animals in the one dose group that did not have detectable viremia until day 3 had the 2 highest NAb activities within that group. FIG. 4B is the probability of infection (Logit) based on the reciprocal $EC_{50}$ NAb titer indicating that prevention of viremia would be expected in approximately 70% of animals with NAb titers>1000. FIG. 4C shows that the level of peak viremia on day 3 is inversely related to the prechallenge serum NAb titer. Viremic animals are shown in red, completely protected animals in grey and the breakthrough animal from the group that received 2×4 mg of VRC5288 is outlined in black. Grey box indicates a NAb titer<1000 reciprocal $EC_{50}$ serum dilution.

Figure 5B:
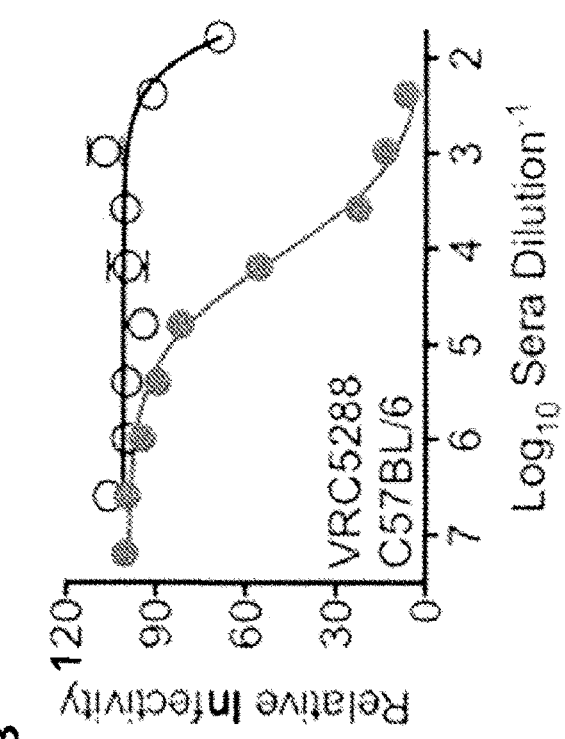
Figure 5A:
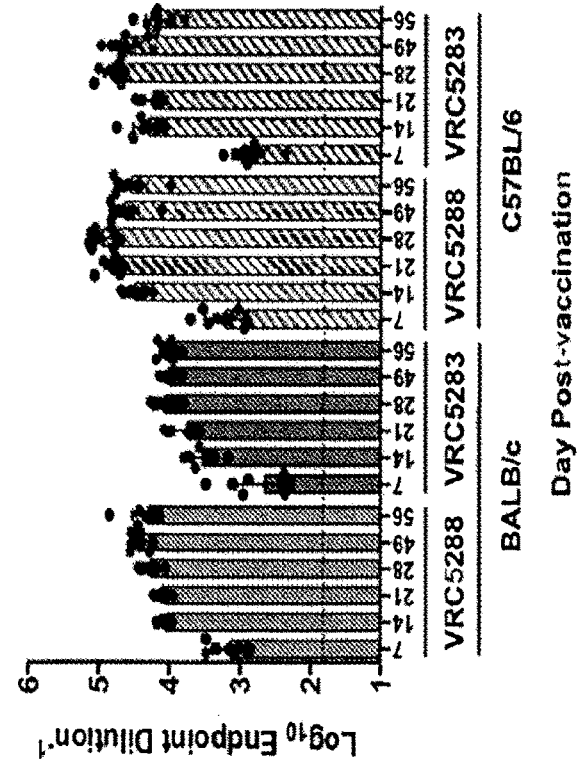
Figure 5D:
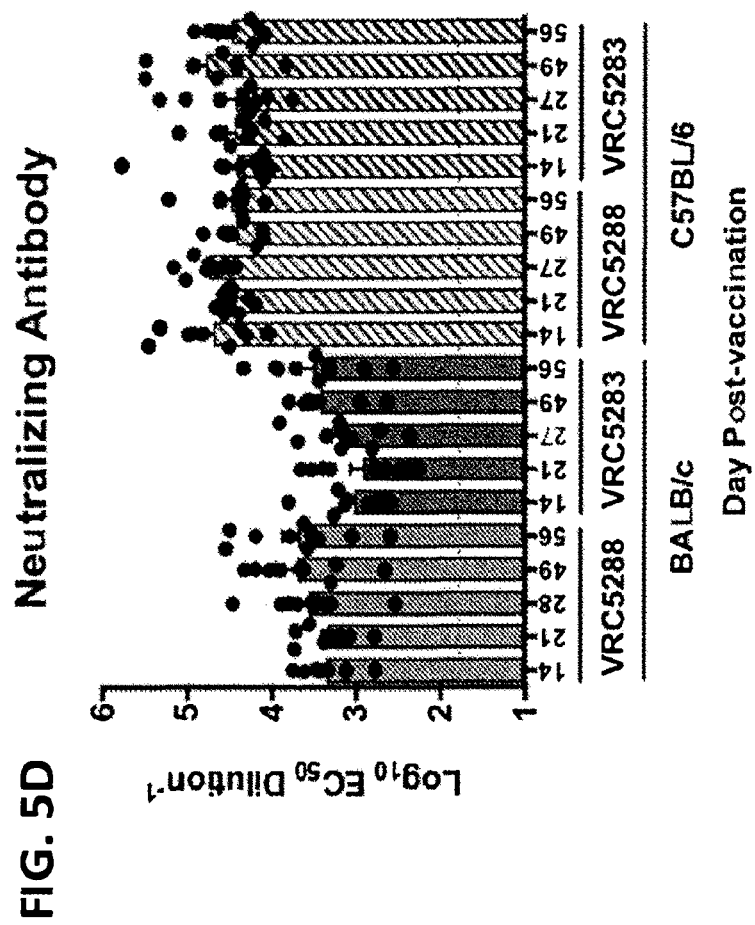
Figure 5C:
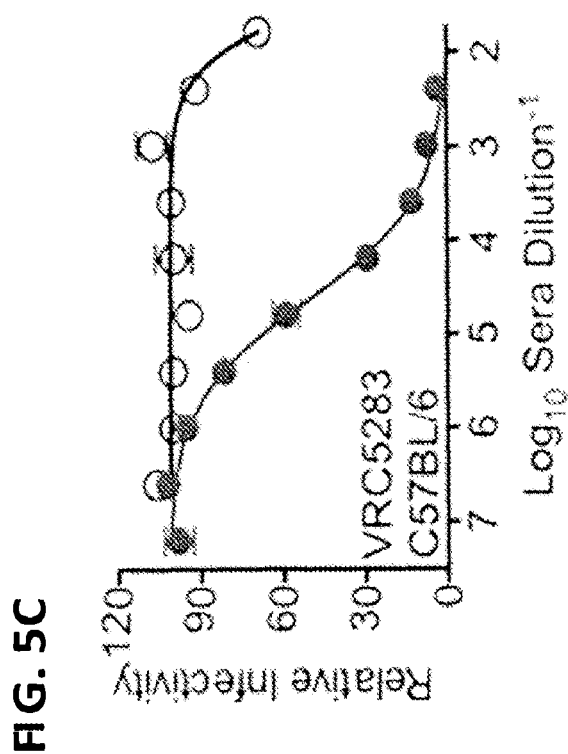

FIGS. 5A-5D demonstrate the immunogenicity of VRC5283 and VRC5288 DNA vaccine candidates in mice. The binding and neutralizing antibody response in mice elicited by vaccination with ZIKV DNA vaccine candidates was analyzed using an ELISA (FIG. 5A) and ZIKV RVPs (FIGS. 5B-5D), respectively. Groups of ten BALB/c and C57BL/6 mice were immunized with one 50 µg dose of VRC5283 or VRC5288 vaccine and bled weekly for serological studies. FIG. 5A shows the binding antibodies assayed using a particle-based ELISA. To assess NAb responses, ZIKV strain H/PF/2013 RVPs were mixed with serial four-fold dilutions of serum for 1 h at 37° C. prior to being added to Raji-DCSIGNR cells. After 48 h, GFP-positive infected cells were quantitated by flow cytometry. The dilution of sera required for half-maximal inhibition of virus infection ($EC_{50}$) was estimated by non-linear regression analysis. Representative dose-response neutralization profiles are shown for individual mice immunized with VRC5288 (FIG. 5B) or VRC5283 (FIG. 5C) DNA vaccine candidates. The neutralizing activity of sera collected 56 days post-vaccination (closed circles) is shown relative to sera collected 59 days post-vaccination from a mouse vaccinated with a control construct, VRC4974 (open circles). VRC4974 is identical to VRC5283 with the exception of a three amino acid deletion at the amino terminus of prM that prevents SVP particle release. Error bars reflect the range of two technical replicates, present even when not visible. FIG. 5D shows the $EC_{50}$ serum neutralization titer determined for each mouse, at each of the indicated time points. Dots denote the titers for individual animals (n=1). Bars and associated error bars denote the group mean neutralization titer and standard error, respectively.

Figure 6:
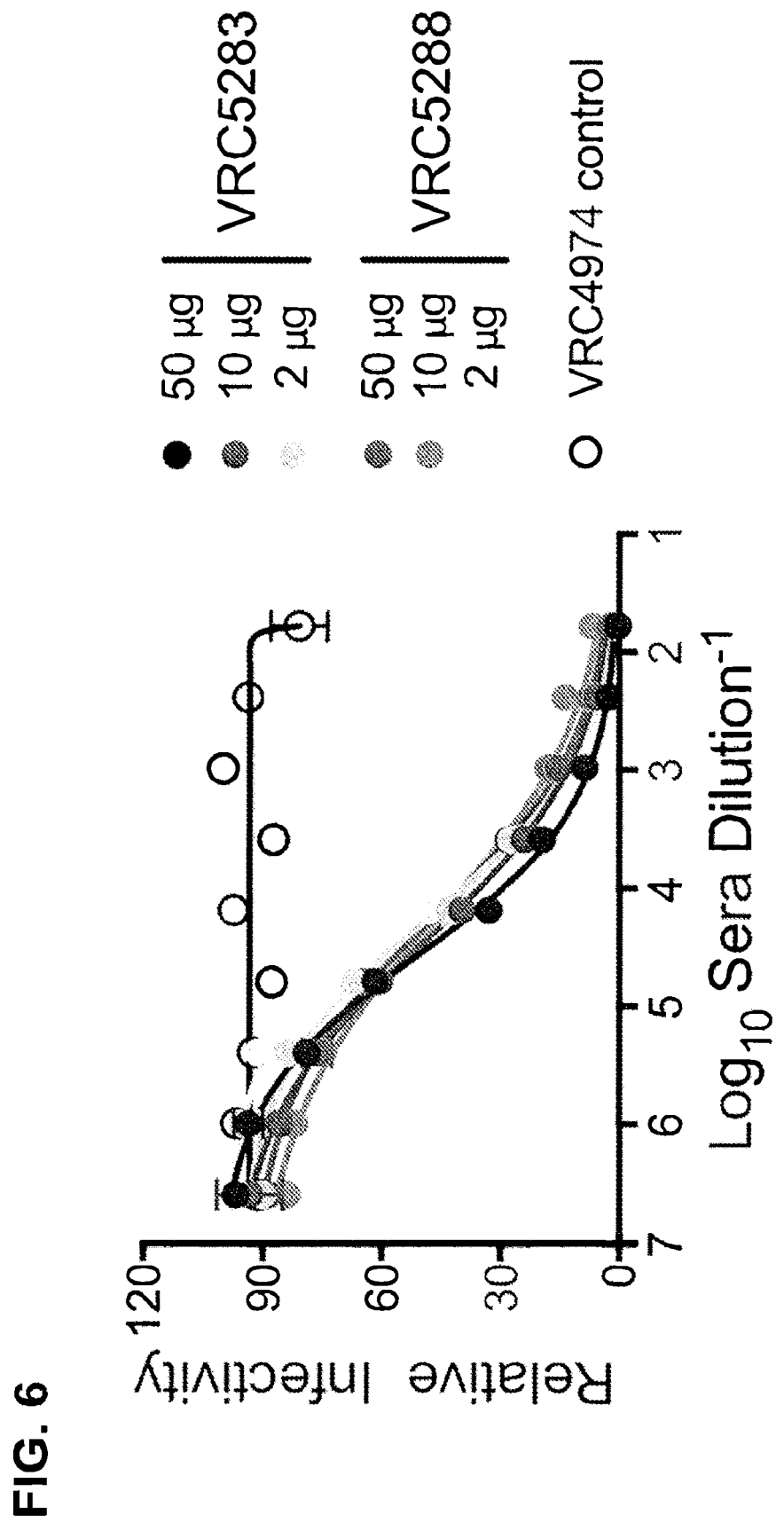

FIG. 6 shows the immunogenicity of increasing doses of VRC5283 and VRC5288 vaccine candidates in mice. ZIKV H/PF/2013 RVPs were mixed with four-fold serial dilutions of sera collected and pooled from four mice 21 days post-vaccination with 2, 10, or 50 µg of VRC5283 or VRC5288, and from sera collected 59 days post-vaccination with a control construct, VRC4974. VRC4974 is identical to VRC5283 with the exception of a three amino acid deletion at the amino terminus of prM that prevents SVP release. Immune complexes were incubated for 1 h at 37° C. prior to being added to Raji-DCSIGNR cells. After 48 h, GFP-positive infected cells were quantitated by flow cytometry and the results analyzed by non-linear regression. Error bars denote the range of technical duplicates, present even when not visible.

Figure 7A:
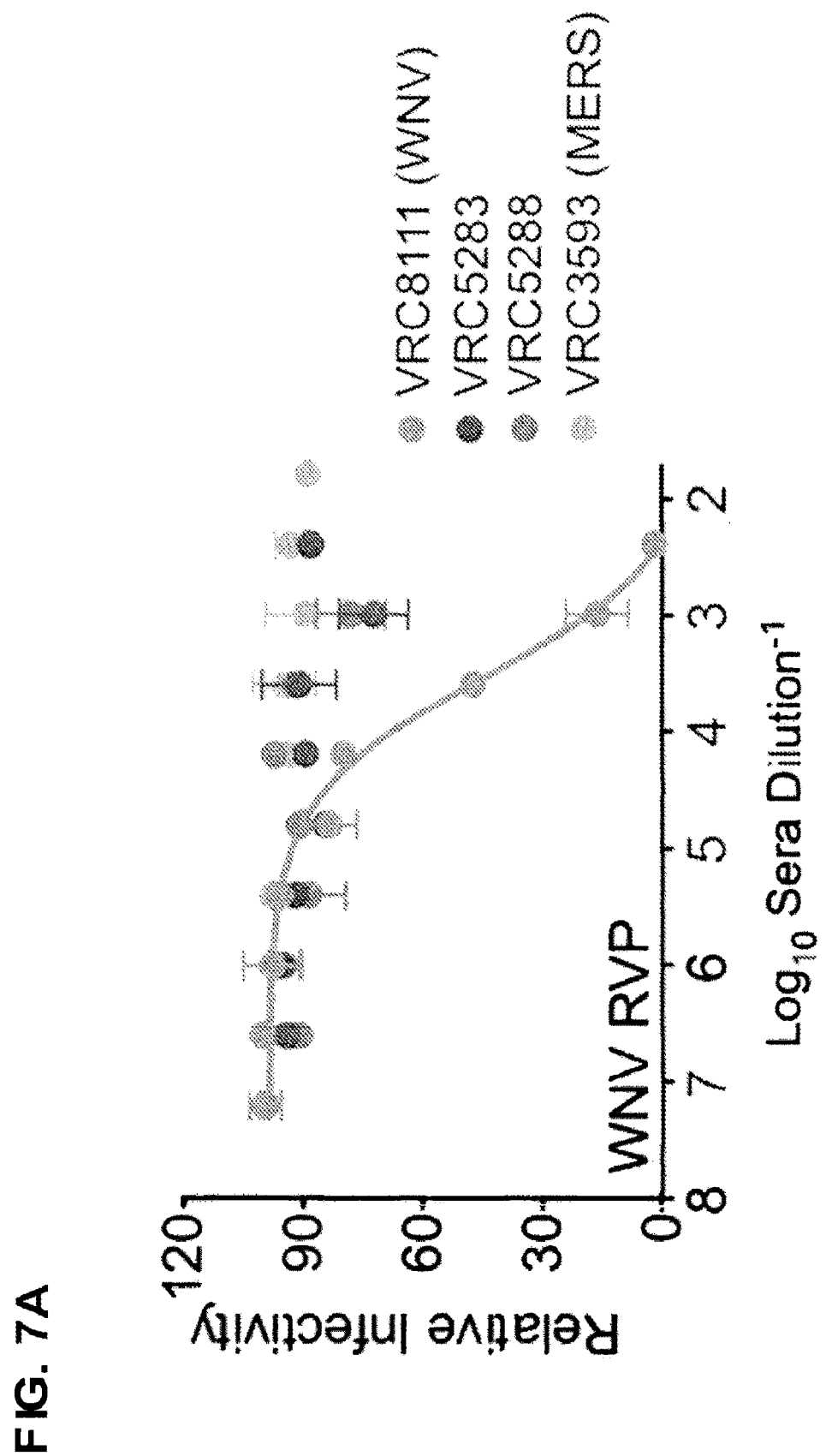
Figure 7B:
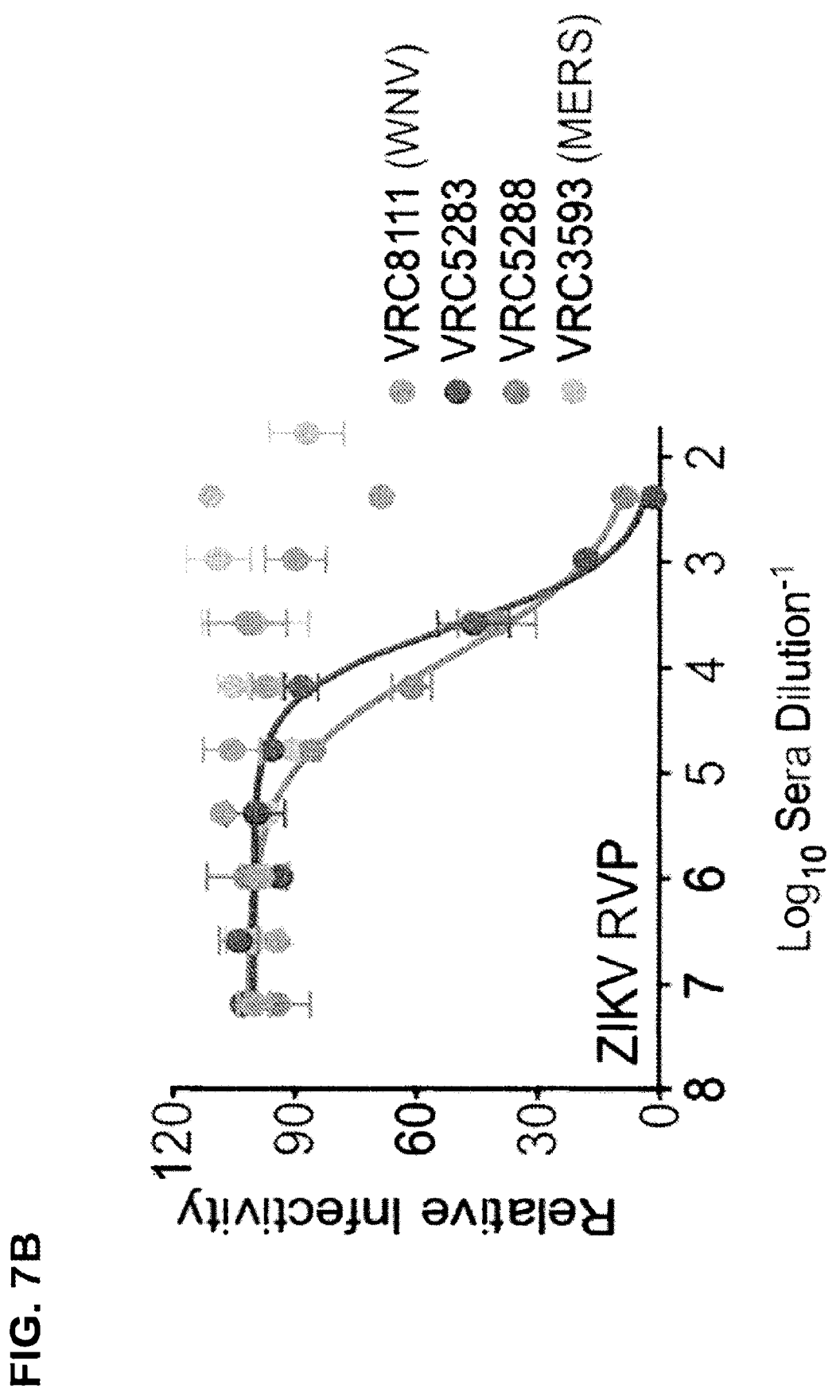

FIGS. 7A and 7B show neutralization of WNV and ZIKV RVPs by DNA vaccine-immune sera. WNV NY99 (FIG. 7A) and ZIKV H/PF/2013 (FIG. 7B) RVPs were mixed with four-fold serial dilutions of sera pooled from four mice 14 days post-vaccination with a single 50 µg dose of WNV (VRC8111), ZIKV (VRC5283 and VRC5288) or MERS (VRC3593) DNA constructs. Immune complexes were incubated for 1 h at 37° C. prior to being added to Raji-DCSIGNR cells. After 48 h, GFP-positive infected cells were quantitated by flow cytometry and the results analyzed by non-linear regression. Dose-response neutralization curves from a representative experiment of two independent assays are shown. Error bars denote the range of technical duplicates.

Figure 8A:
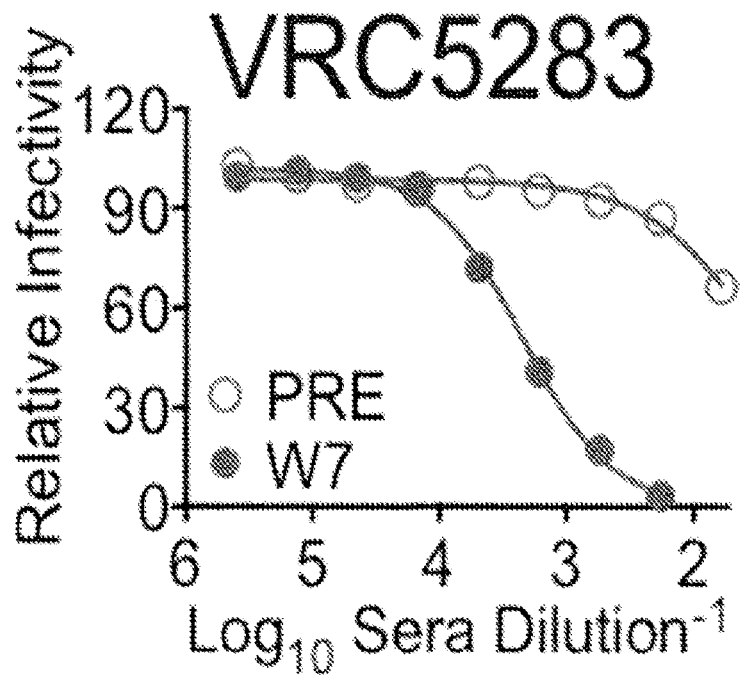
Figure 8B:
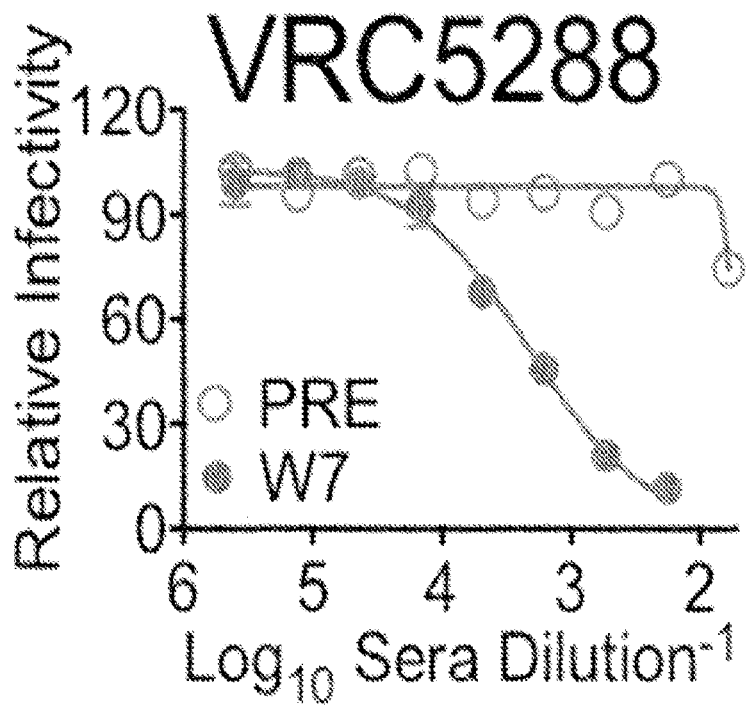
Figure 8C:
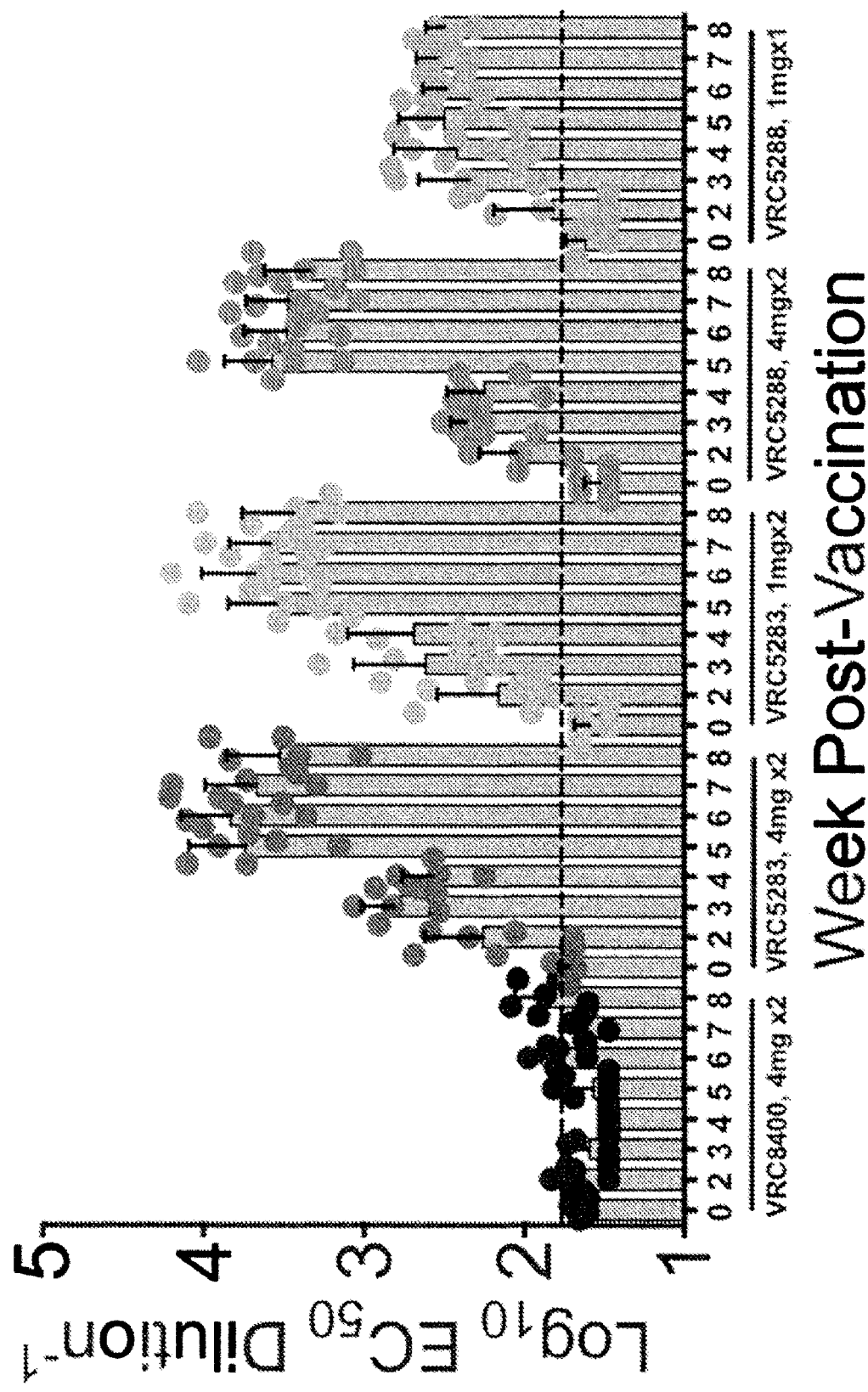
Figure 9A:
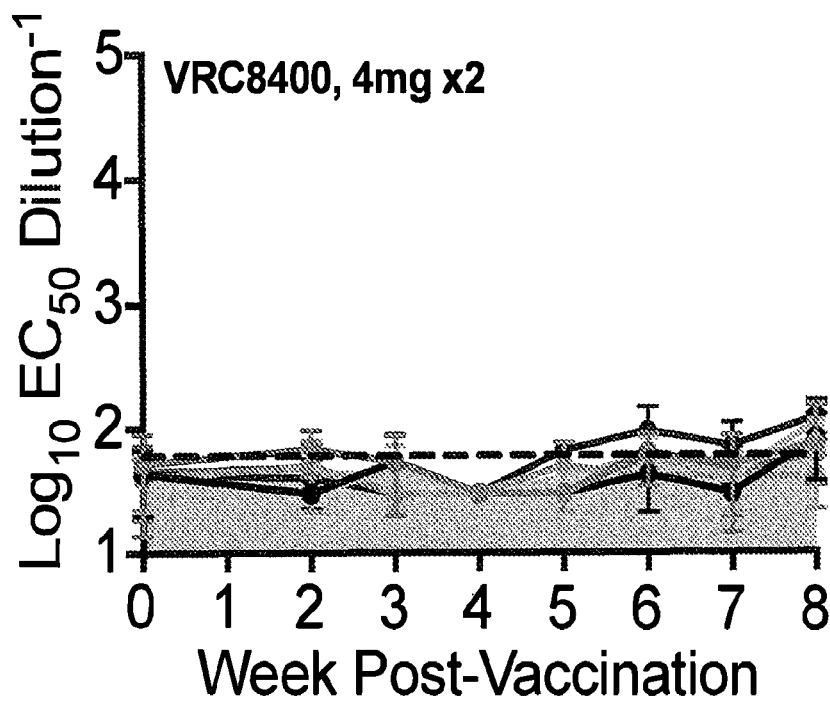
Figure 9B:
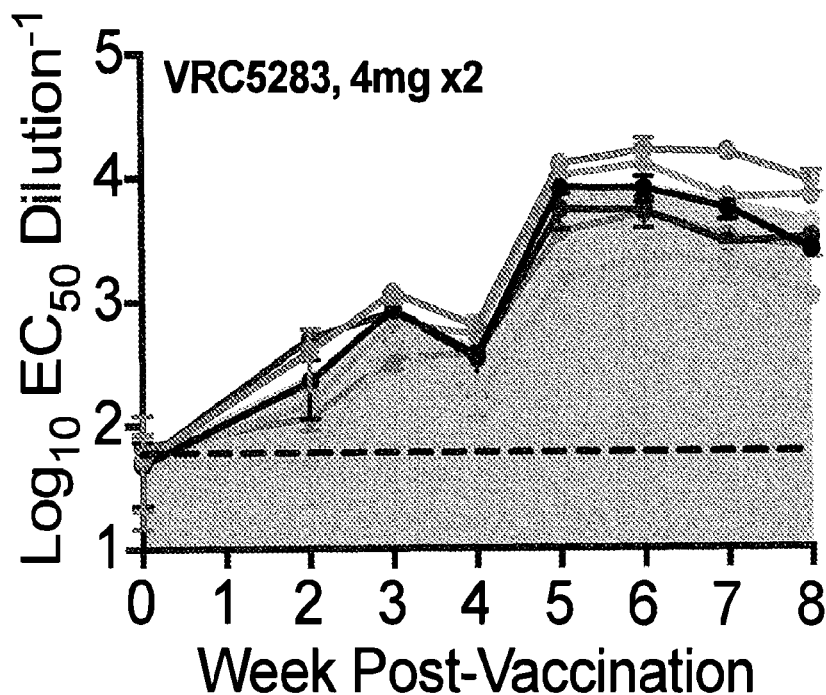
Figure 9C:
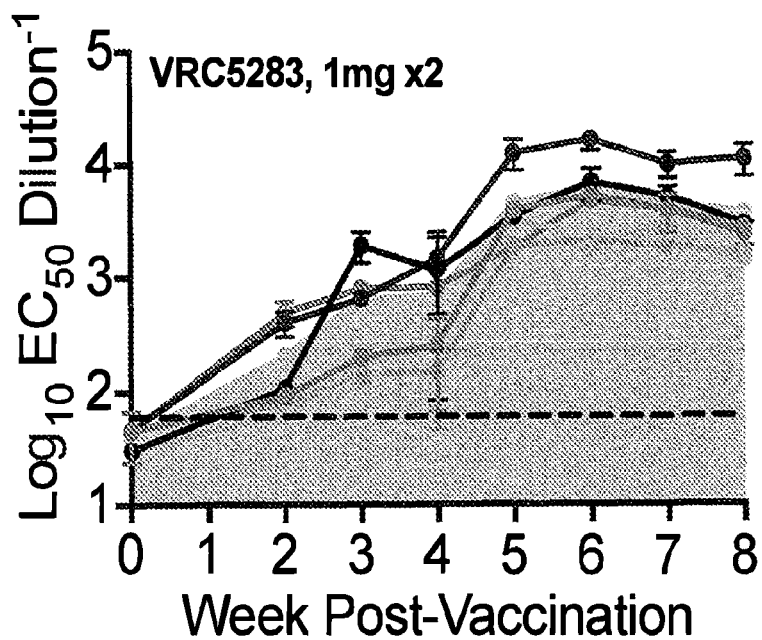
Figure 9D:
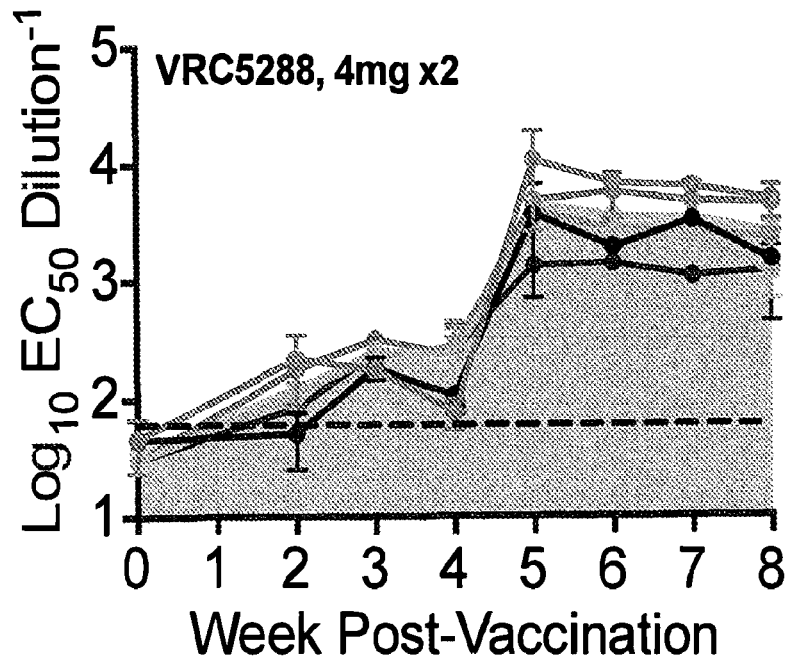
Figure 9E:
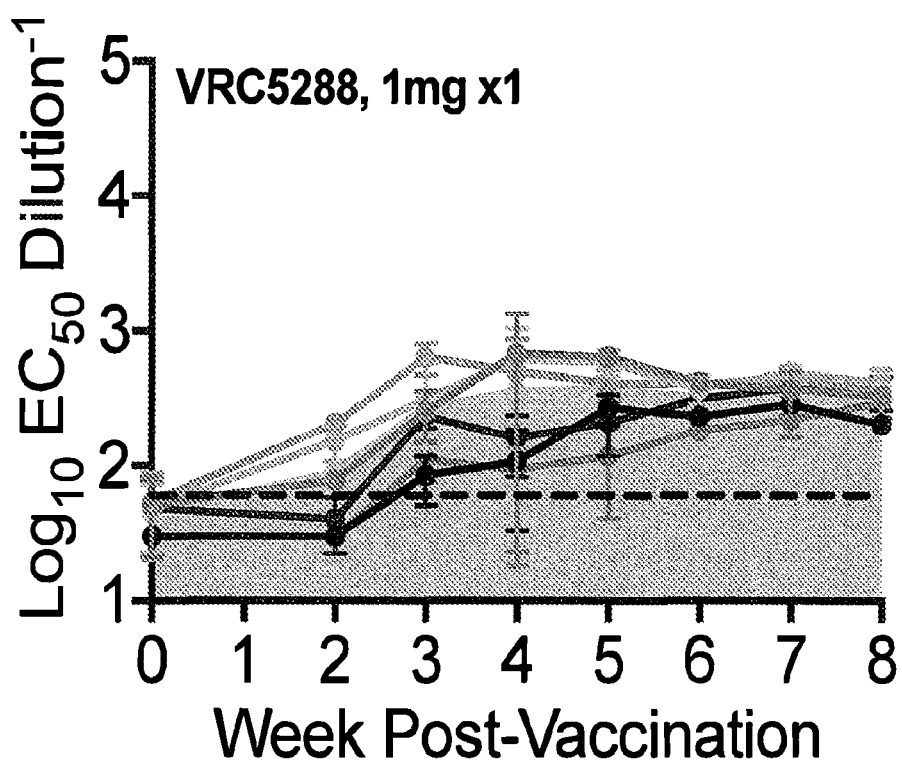

FIGS. 8A-8C shows the immunogenicity of VRC5283 and VRC5288 vaccine candidates in nonhuman primates. The NAb response in macaques elicited by vaccination with ZIKV DNA vaccine candidates was analyzed using ZIKV RVPs as described in FIG. 2. Representative dose-response neutralization profiles are shown for individual animals immunized with VRC5283 (FIG. 8A) or VRC5288 (FIG. 8B) DNA vaccine candidates. The neutralizing activity of sera collected 7 weeks post-vaccination (W7, closed circles) is shown relative to pre-immune sera from the same animal (PRE, open circles). Error bars reflect the range of two technical replicates, present even when not visible. FIG. 8C shows the $EC_{50}$ serum neutralization titer determined for each animal, at each of the indicated timepoints. Dots denote the average titers for individual animals, calculated from 2-5 independent experiments. Bars and associated error bars denote the group mean neutralization titer and standard deviation, respectively. The dotted line denotes the limit of confidence for the RVP assay (defined by the highest concentration of sera used in the assay); samples with titers<60 are reported at half the limit of detection (1:30).

FIG. 9A-E show the magnitude of the neutralizing antibody response elicited in vaccinated nonhuman primates as a function of pre-immune titers. The NAb response in macaques elicited by vaccination with ZIKV DNA vaccine candidates was analyzed using ZIKV RVPs as described in FIG. 2. The data presented represents the fold-change in the $EC_{50}$ titer of sera collected at the indicated time post-vaccination as compared to the pre-immune titer of that same animal (Post-vaccination $EC_{50}$/Pre-immune $EC_{50}$).

Lines represent individual animals and connect the fold-change values calculated from average $EC_{50}$ NAb titers at each timepoint that are representative of 2-5 independent experiments, each performed with duplicate technical replicates. In each panel, the area under the curve for the line connecting group mean fold-change values is shaded gray. The dotted line denotes four standard deviations from pre-immune $EC_{50}$ NAb titers. Note that the scales of the left-most and right-most panels have a smaller range than the middle three panels.

Figure 10A:
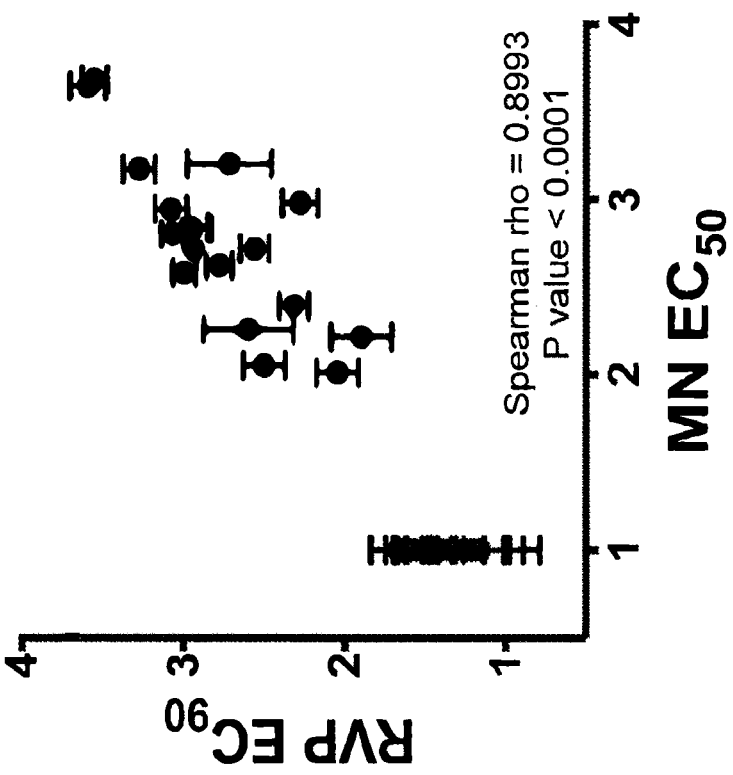
Figure 10B:
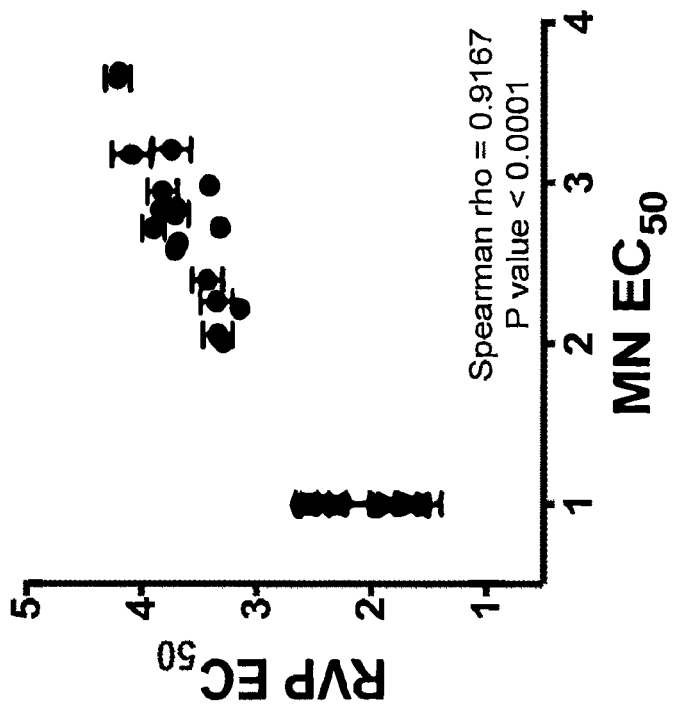
Figure 10C:
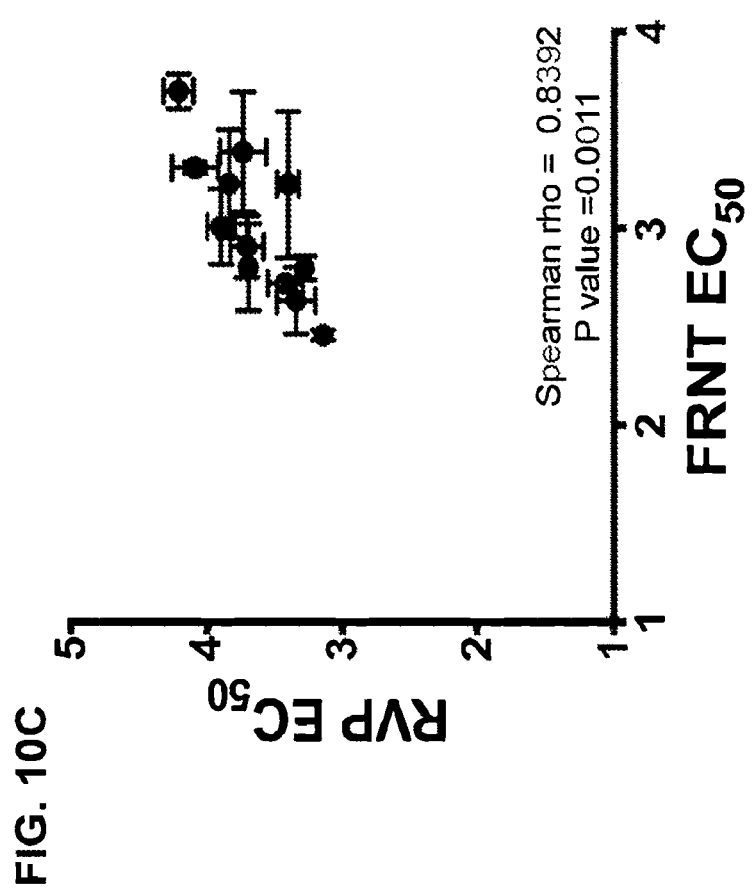

FIGS. 10A-10C show a comparison of serum neutralization titers determined by three distinct assays. The neutralizing potency of nonhuman primate sera collected 6 weeks after vaccination was determined by three ZIKV neutralization assays: reporter virus particles (RVP), microneutralization (MN), or focus reduction neutralization test (FRNT). Sera from all 30 animals comprising all five vaccination groups were tested in the RVP and MN assays. A subset of monkeys, the 12 animals that received two doses of 4 mg VRC5283 or VRC5288, was assessed via FRNT. Neutralization titers for individual serum samples tested using the indicated assays are plotted on the x- and y-axis. Shown are comparisons of RVP $EC_{50}$ versus MN $EC_{50}$ (FIG. 10A), RVP $EC_{90}$ versus MN $EC_{50}$ (FIG. 10B), and RVP $EC_{50}$ versus FRNT $EC_{50}$ (FIG. 10C). RVP $EC_{50}$ and $EC_{90}$ values represent the average of 2-4 independent experiments performed with duplicate technical replicates, FRNT $EC_{50}$ values represent the average of 1-4 independent experiments performed with duplicate technical replicates, and MN $EC_{50}$ values represent a single experiment. Error bars reflect the standard deviation. The correlation between independent measurements was evaluated by Spearman's correlation.

Figure 11A:
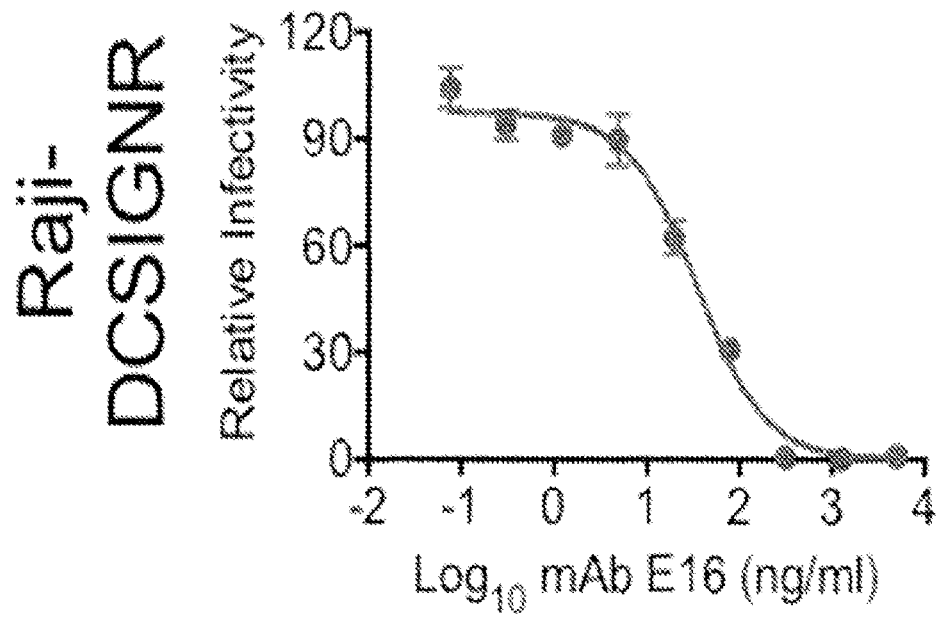
Figure 11B:
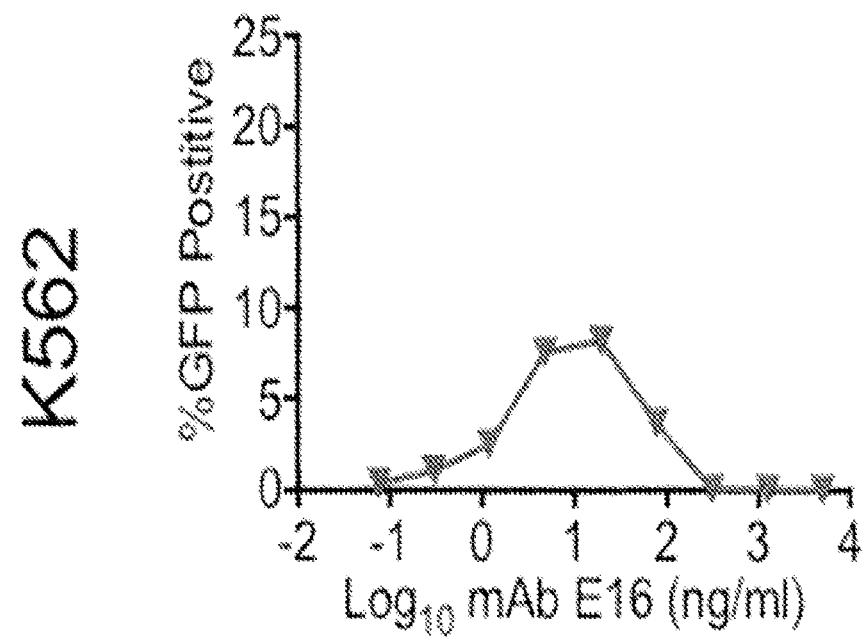
Figure 11C:
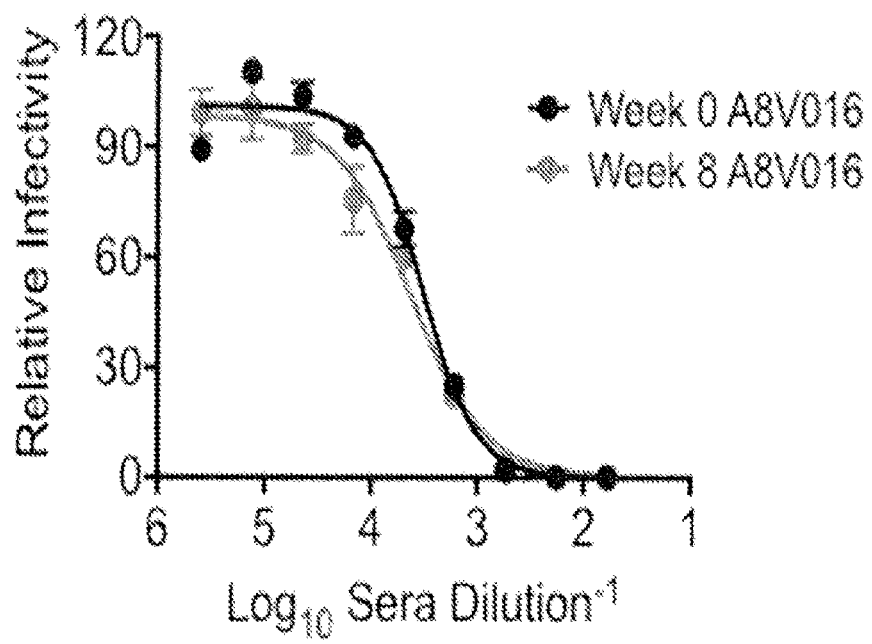
Figure 11D:
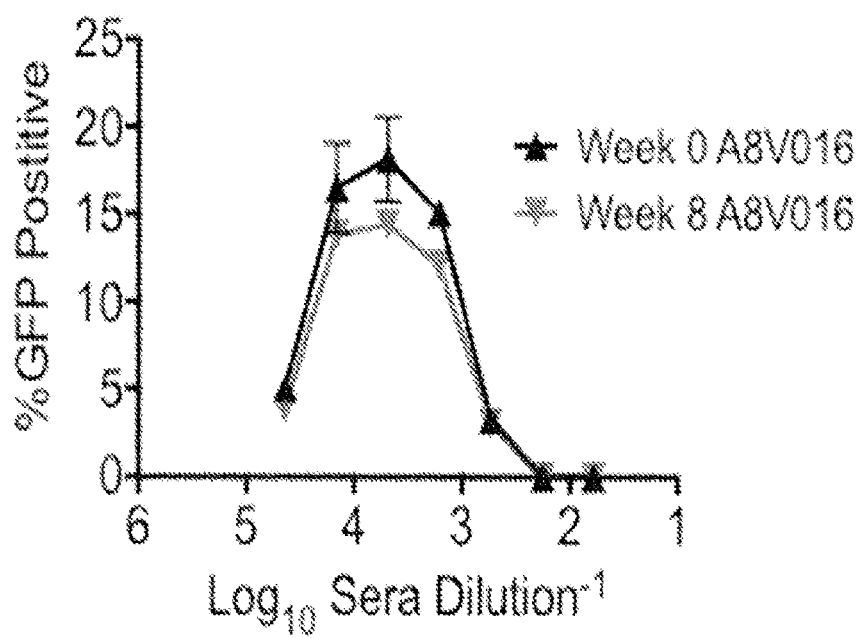
Figure 11E:
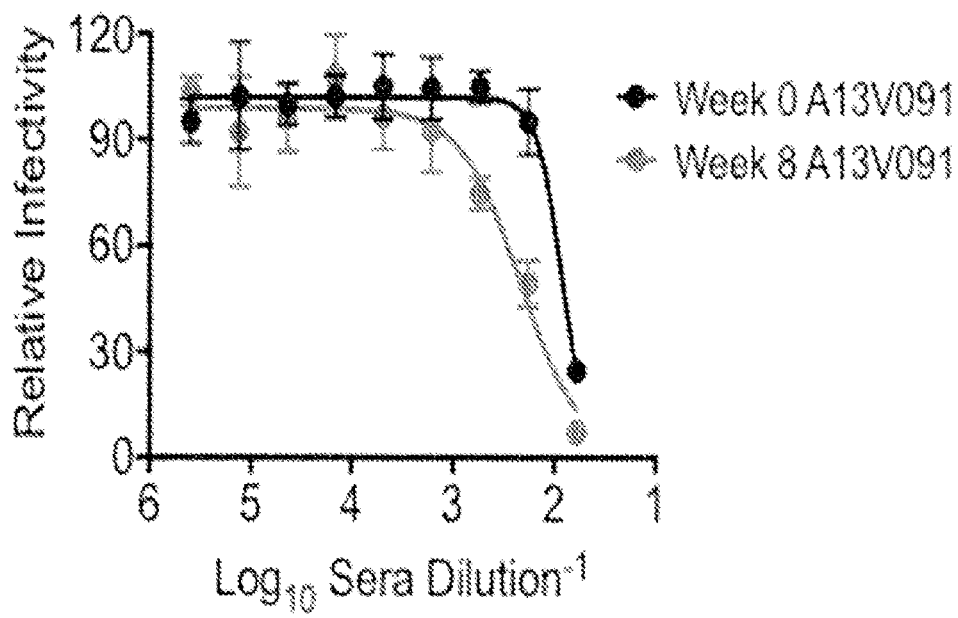
Figure 11F:
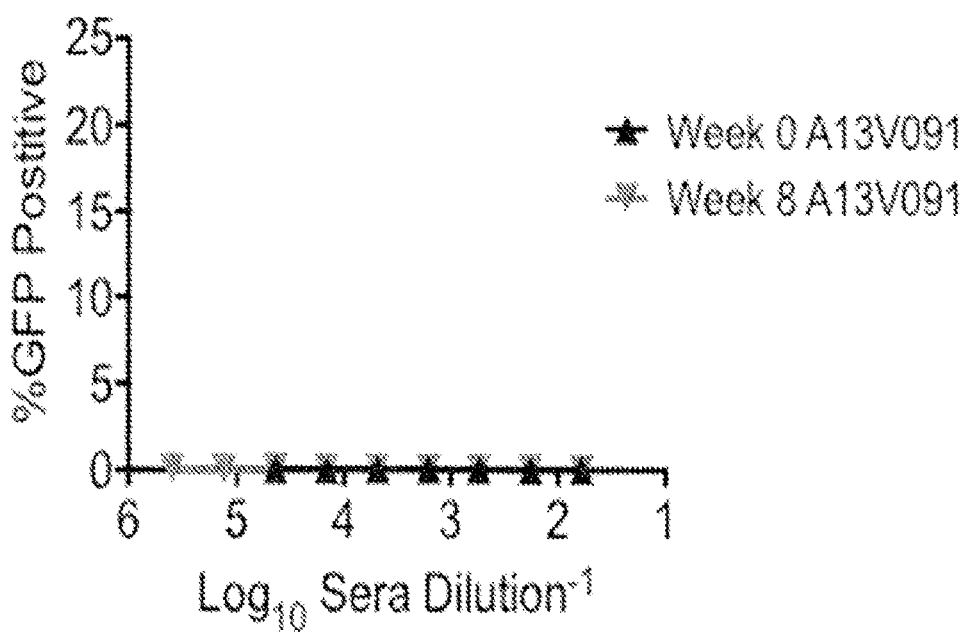
Figure 11G:
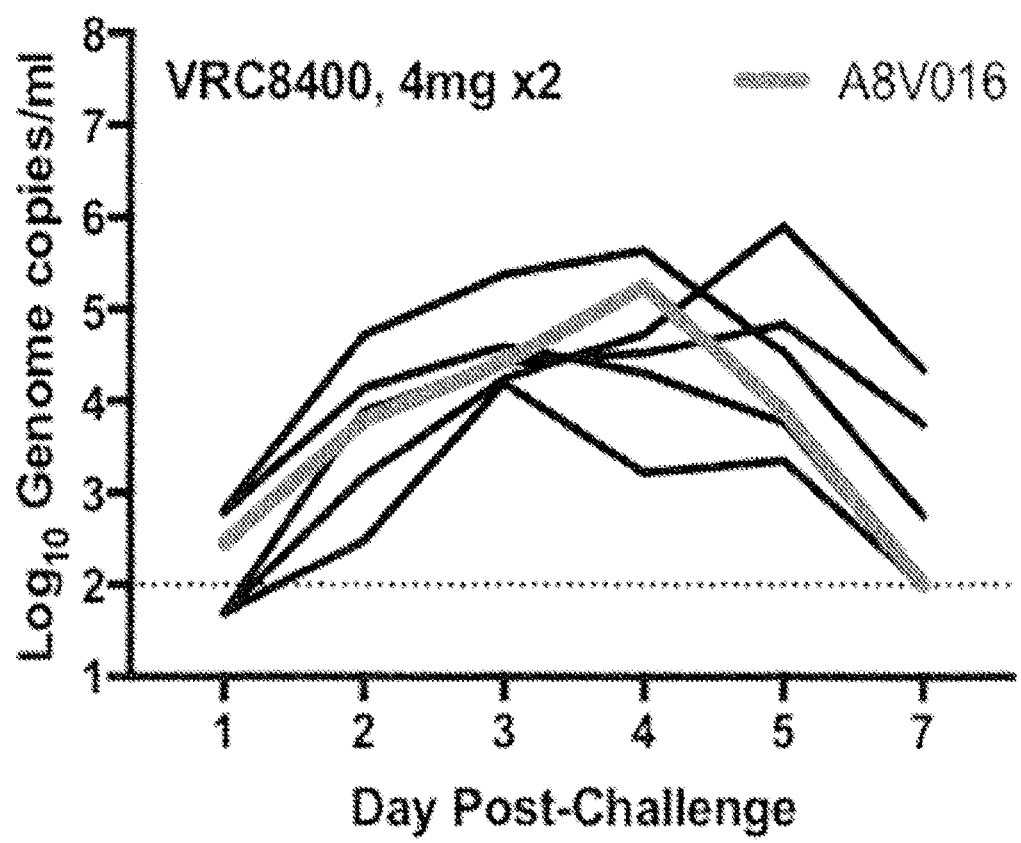

FIGS. 11A-11G. demonstrate that prior WNV infection does not protect against or enhance ZIKV infection. Sera from one of six control animals (macaque A8V016) that received two doses of 4 mg VRC8400 displayed detectable ZIKV antibody binding by ELISA but no neutralizing activity. To investigate whether this animal had pre-existing immunity to the related flavivirus WNV, WNV NY99 RVPs were mixed with serial dilutions of a potently neutralizing WNV mAb E16 (FIGS. 11A & 11B), week 0 and 8 sera from macaque A8V016 (FIGS. 11C & 11D), and week 0 and 8 sera from a second control group animal, macaque A13V091 (FIGS. 11E & 11F). Immune complexes were incubated for 1 h at 37° C. prior to being added to Raji-DCSIGNR or FcγR+K562 cells to detect neutralizing and enhancing activity, respectively. After 48 h, GFP-positive infected cells were quantitated by flow cytometry and the Raji-DCSIGNR results analyzed by non-linear regression. Error bars denote the range of duplicate technical replicates from a single assay. The ability to both neutralize and enhance infection of WNV RVPs indicates prior WNV exposure in macaque A8V016. (FIG. 11G) Viral loads of animals vaccinated with two 4 mg doses of VRC8400 on day 1-7 after challenge. Macaque A8V016 is shown in purple demonstrating no protection from or enhancement of ZIKV infection.

FIG. 12 shows the Phase I VRC 319 Study Schema for evaluation of safety and immunogenicity of VRC5288. Two or three doses of VRC5288 plasmid was administered by needle and syringe in four different regimens with X denoting immunizations. Each group had 20 subjects who received the VRC588 plasmid by needle and syringe with 4 mg/injection.

Figure 13A:
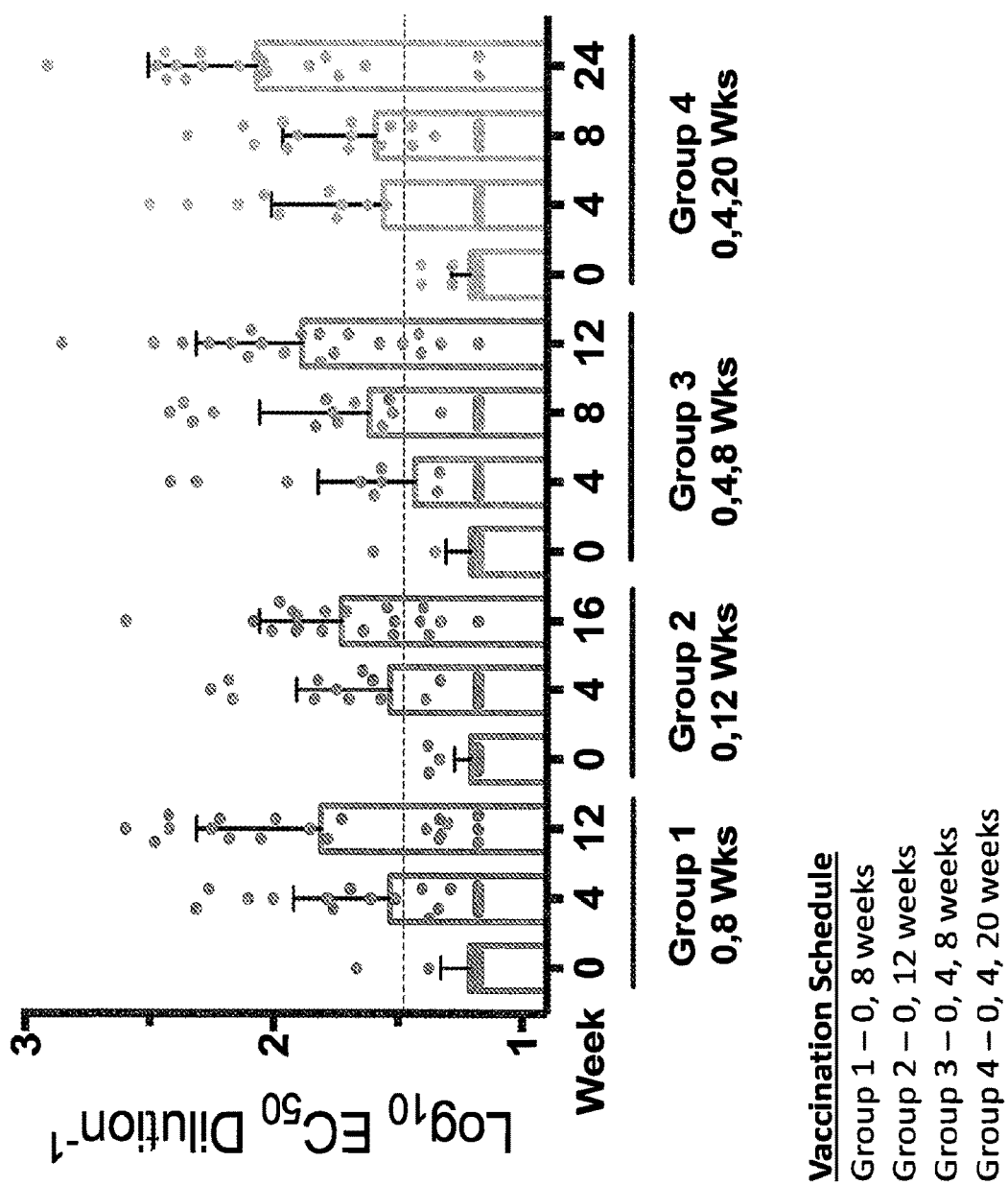
Figure 13B:
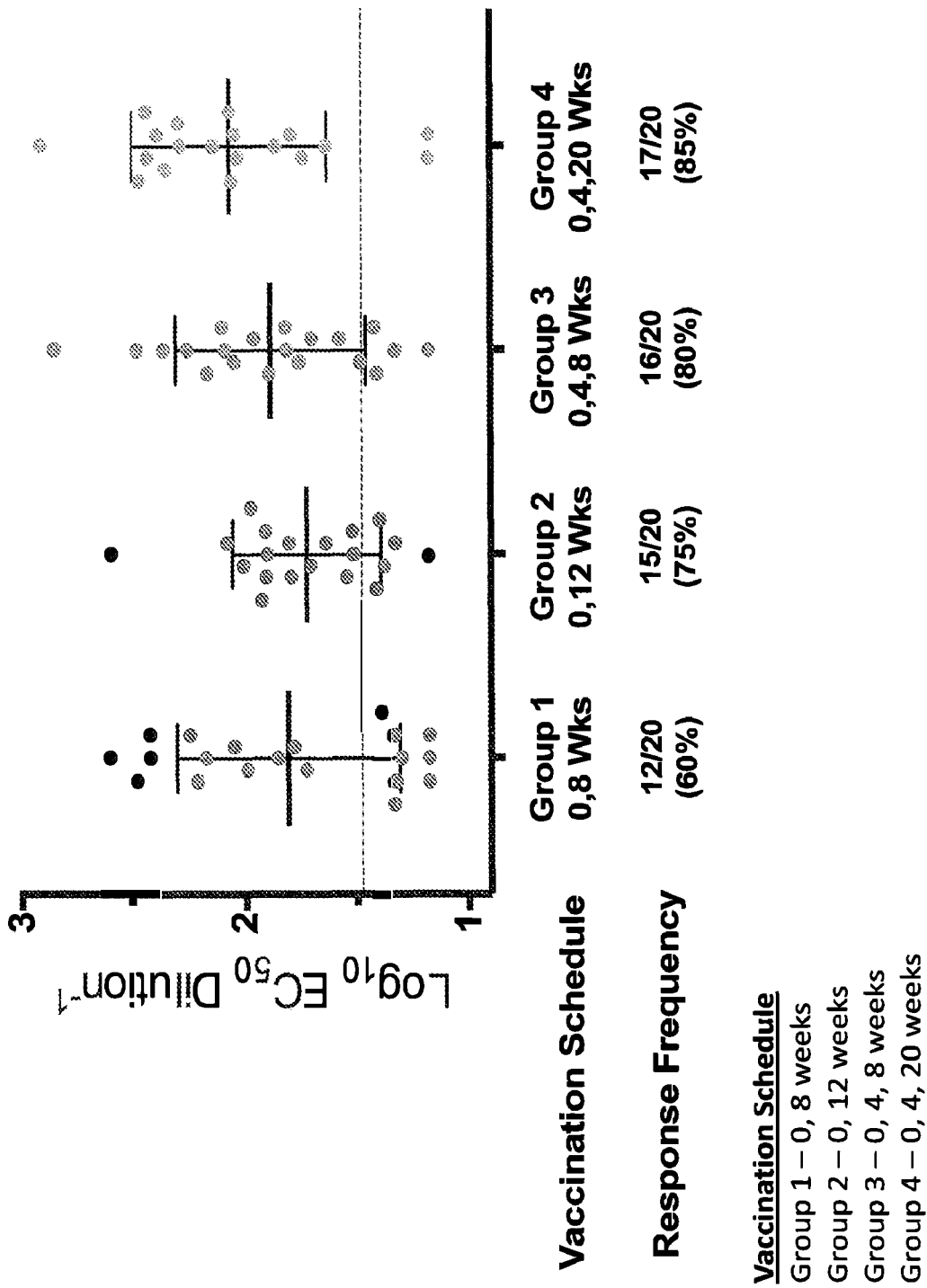

FIGS. 13A & 13B demonstrate that the VRC5288 DNA plasmid is immunogenic in humans. Neutralizing antibody titers were determined at week 0 and 4-weeks after each immunization and are shown as reciprocal Log 10 EC50 dilution. Bars indicate geometric mean of all subjects and error bars indicate standard deviation. Dotted line indicates limit of detection of the assay. All points below the limit of detection were given a value of ½ the limit of detection (EC50 of 15). Data points are the mean of at least two independent assays. Frequency of responders and neutralizing antibody titers 4-weeks after the last vaccination are shown in FIG. 13B. Error bars indicate geometric mean and standard deviation. Responders are defined as subjects with reciprocal EC50 values over 30 which is the limit of detection of the assay.

FIG. 14. Tabular immunogenicity data from the VRC 319 trial demonstrating that VRC5288 elicits neutralizing antibodies against ZIKV. This table shows the median reciprocal EC50 titer, geometric mean reciprocal EC50, and range of reciprocal EC50 titers of the responders in each group. Responders are defined as subjects with reciprocal EC50 values over 30 which is the limit of detection of the assay.

FIG. 15 shows the Phase I VRC 320 Study Schema for evaluation of safety and immunogenicity of VRC5283. This study evaluated three methods of administration: a single injection of 4 mg of VRC5283 in 1.0 ml (Group 1), a split dose of 4 mg of VRC5283 with 2 mg in 0.5 ml being injected in each arm (Group 2), and needle-free administration using the Pharmajet injection device delivered as two 0.5 ml (2 mg) injections, one in each arm (Group 3) (FIG. 15). All groups received three injections at 4 week intervals. Each group had 15 subjects.

Figure 16A:
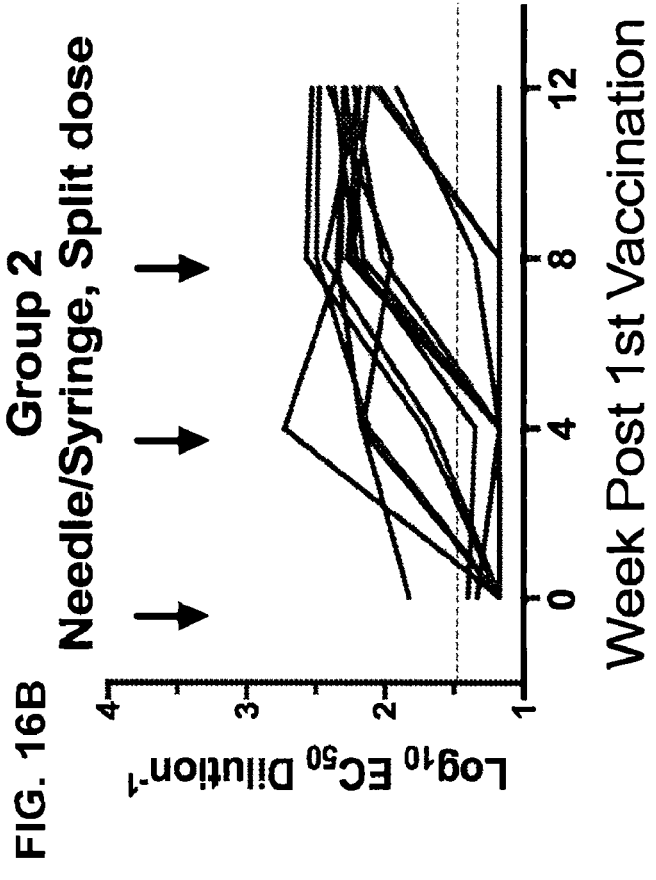
Figure 16B:
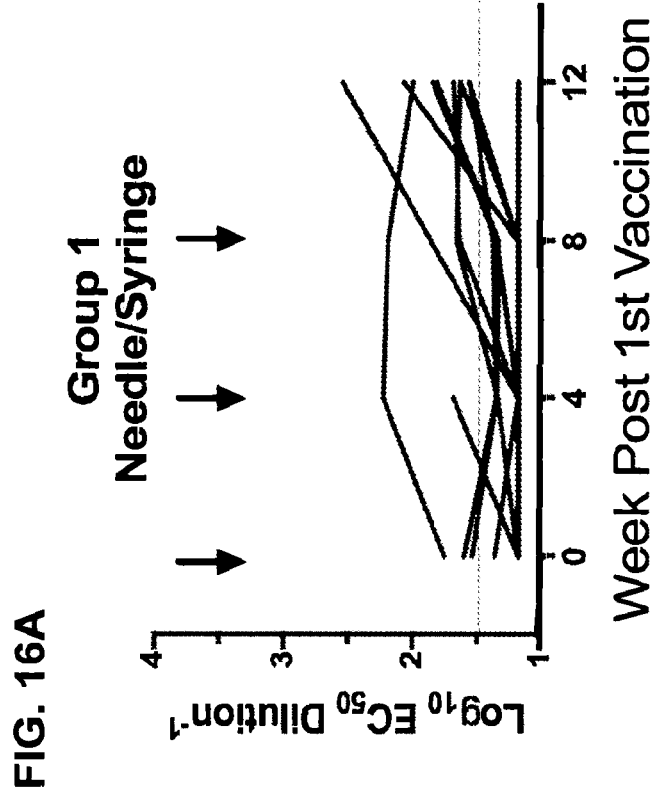
Figure 16C:
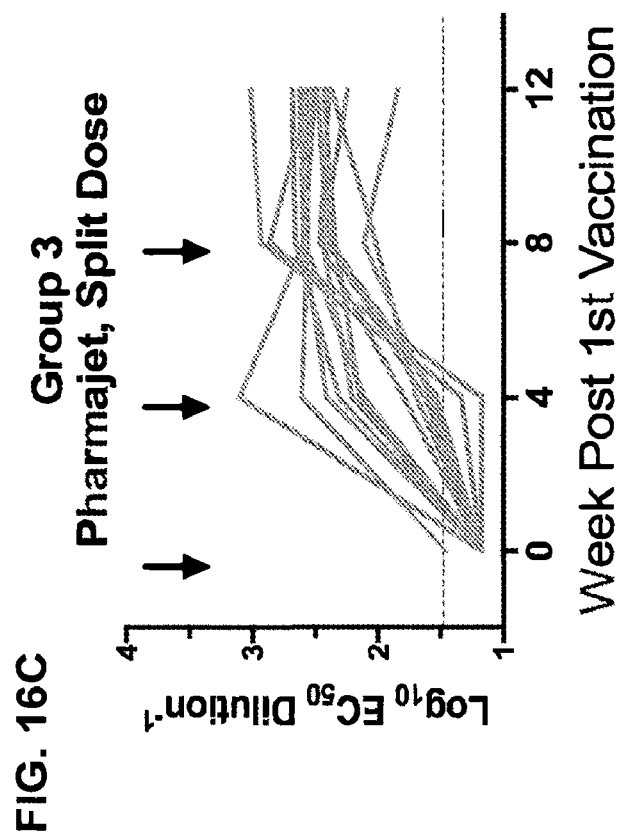

FIGS. 16A-C demonstrates that the VRC5283 DNA plasmid is immunogenic in humans. Neutralizing antibody titers were determined at week 0 and 4-weeks after each immunization by RVP assay and are shown as reciprocal Log 10 EC50 dilution. Group 1 (FIG. 16A) received a single injection by needle and syringe of VRC5283 at each vaccination. Group 2 (FIG. 16B) received two 0.5 ml, 2 mg injections by needle and syringe in different arms at each vaccination. Group 3 (FIG. 16C) received two 0.5 ml, 2 mg injections by Pharmajet in different arms at each vaccination. Arrows indicate immunization and each line represents an individual subject. Dotted line indicates limit of detection of the assay. All points below the limit of detection were given a value of ½ the limit of detection (EC50 of 15). Data points are the mean of at least two independent assays.

Figure 17A:
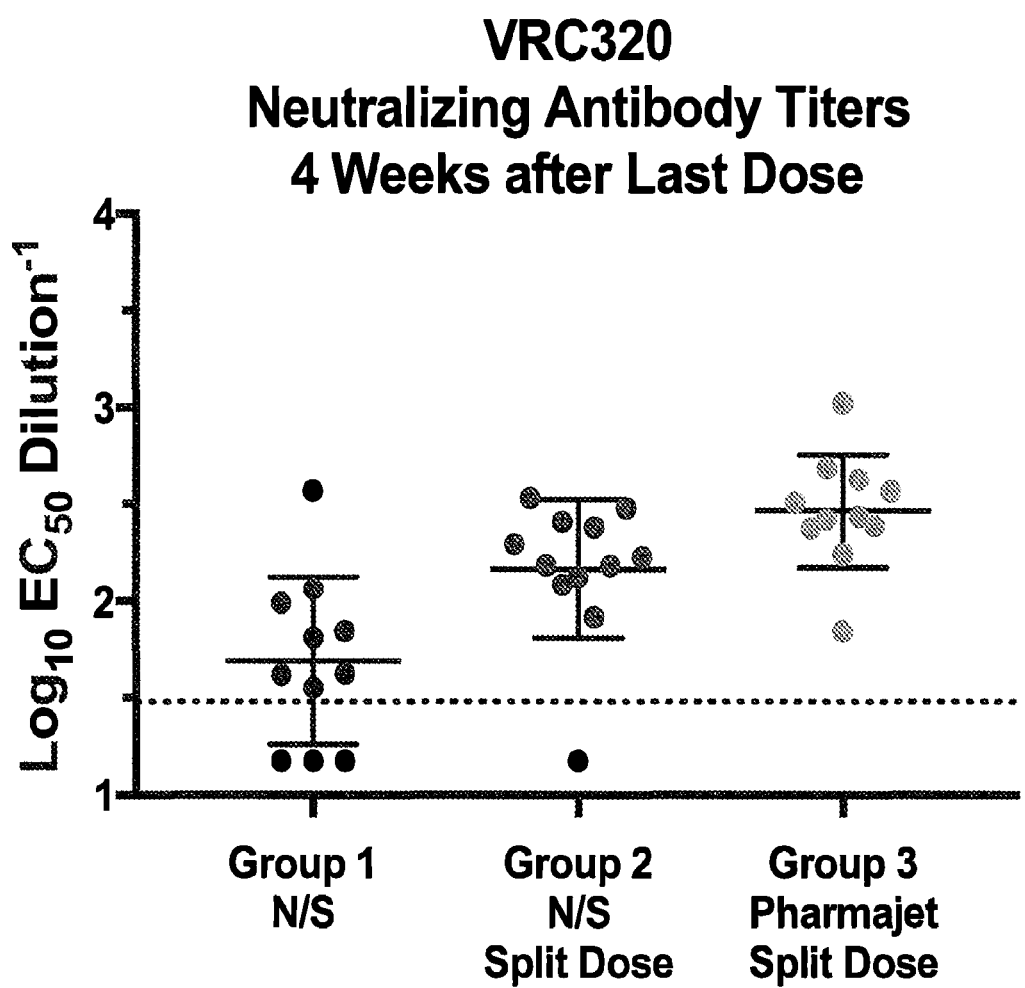
Figure 18:
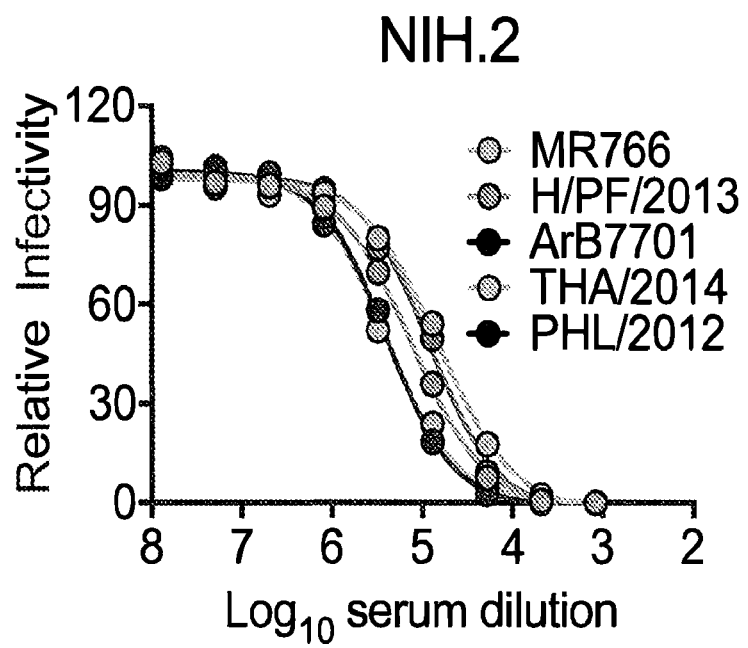
Figure 18B:
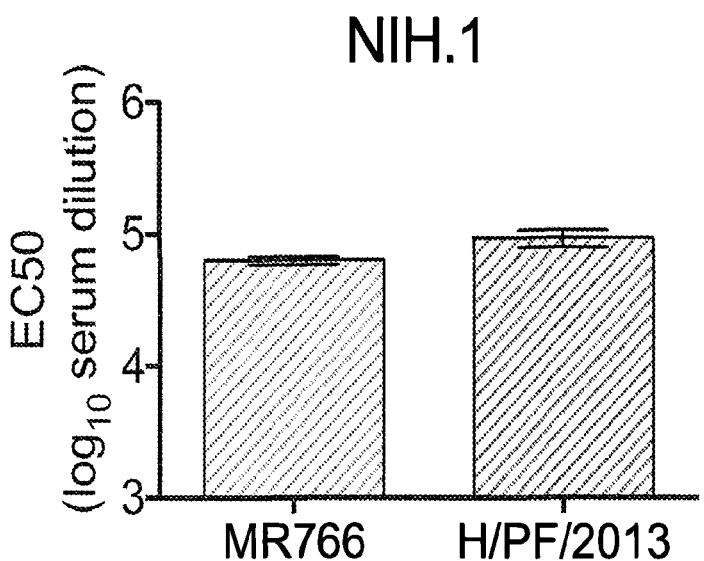
Figure 18C:
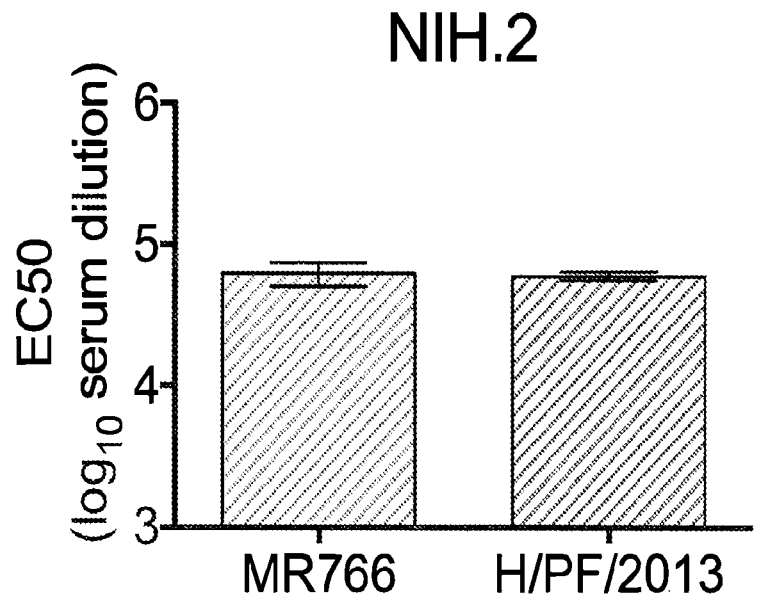
Figure 18D:
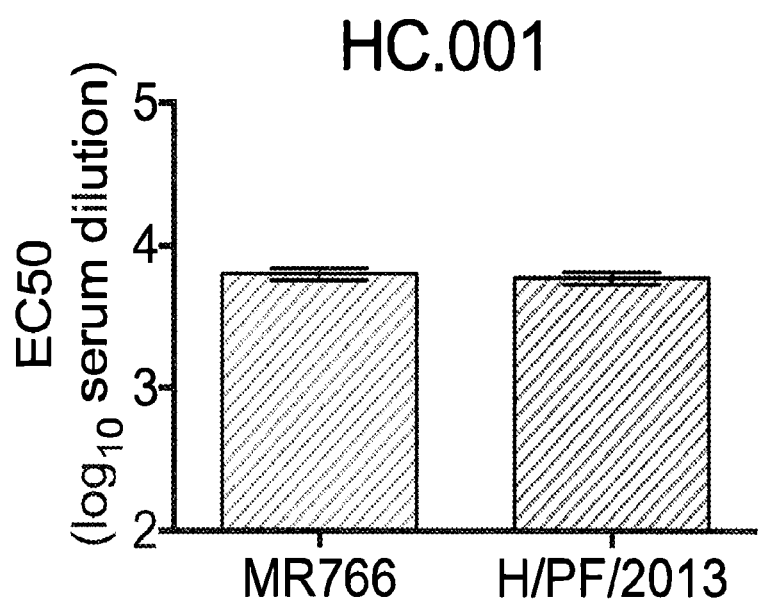
Figure 18E:
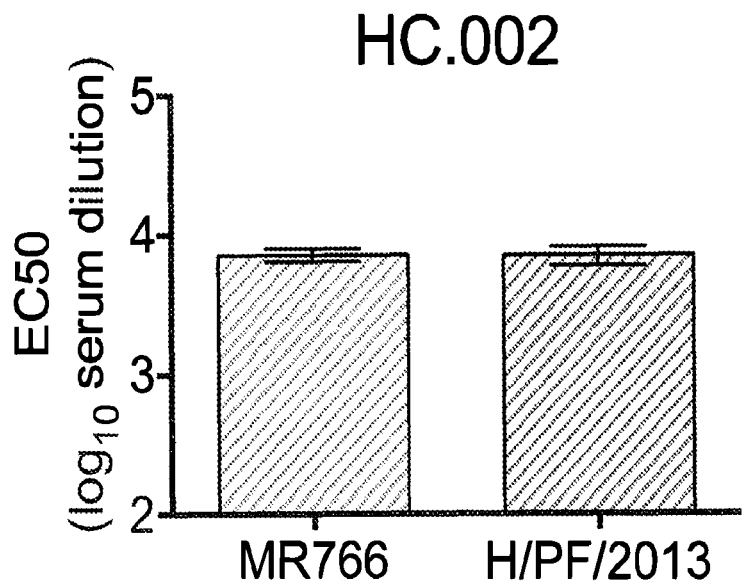
Figure 18F:
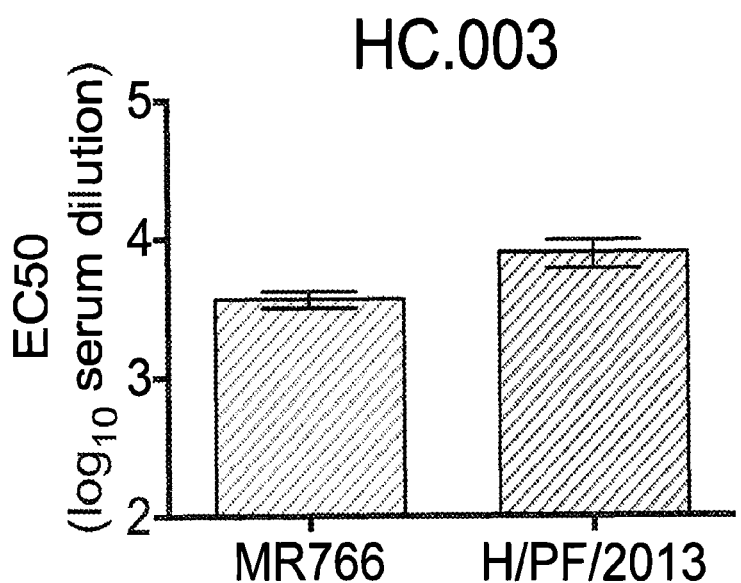
Figure 18G:
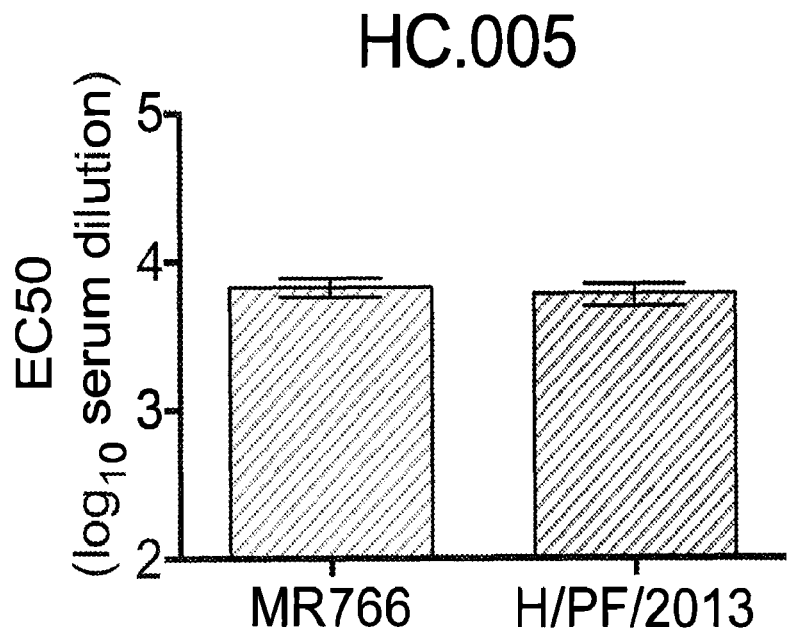
Figure 18H:
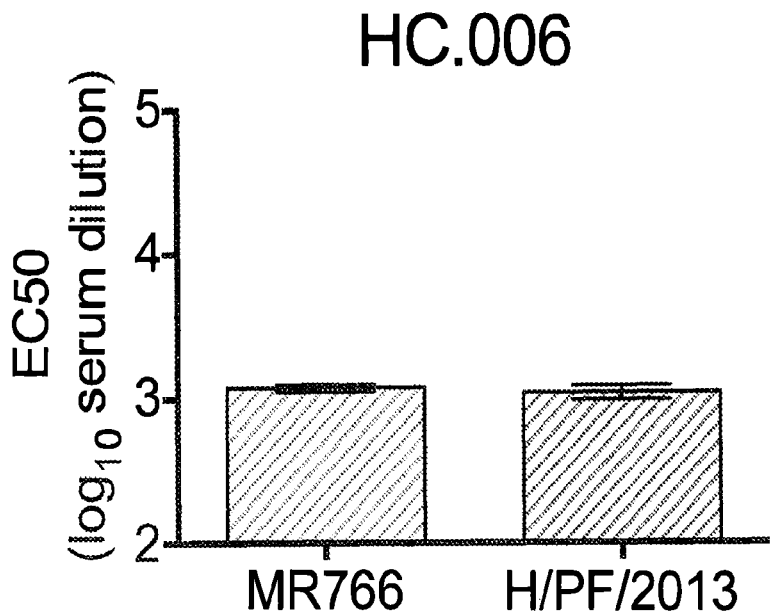
Figure 18I:
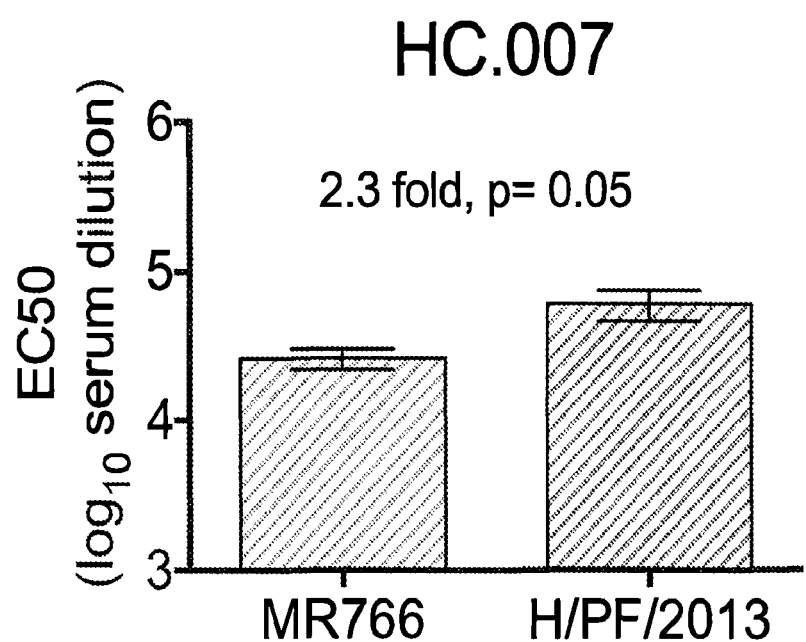

FIGS. 17A & 17B show the interm analysis of neutralizing antibody titers determined by RVP assay at four weeks after the last vaccination. Error bars indicate mean+/−the standard deviation. Data from the first 12 subjects/group is shown. Dotted line indicates limit of detection of the assay. FIG. 17B shows the tabular immunogenicity results indicating increased response rate and immunogenicity when VRC5383 is administered by pharmajet. These data include the response rate, median reciprocal EC50 titer, and geometric mean reciprocal EC50 of all subjects. Responders are defined as subjects with reciprocal EC50 values over 30 which is the limit of detection of the assay. * indicates that 1 subject was lost to follow up in each of the group FIGS. 18A-18I Neutralization of RVPs by ZIKV-immune human serum. (FIG. 18A) Neutralization curves for a representative experiment (of three independent assays) are shown for serum NIH.2 against all five ZIKV RVPs. Error bars denote the range of duplicate technical replicates (present even when not visible due to low variation). (FIGS. 18B-I) The average EC50 neutralization titers obtained from independent neutralization studies for eight ZIKV-immune convalescent sera measured against MR-766 and H/PF/2013 RVPs are shown. Error bars reflect the SE of 5-10 experiments. Statistical differences in the mean EC50 values were identified using an unpaired t test; the fold difference and p values are displayed when significant (only I).

Figure 19A:
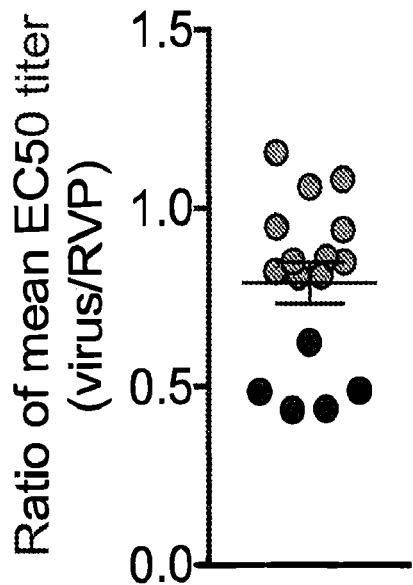
Figure 19B:
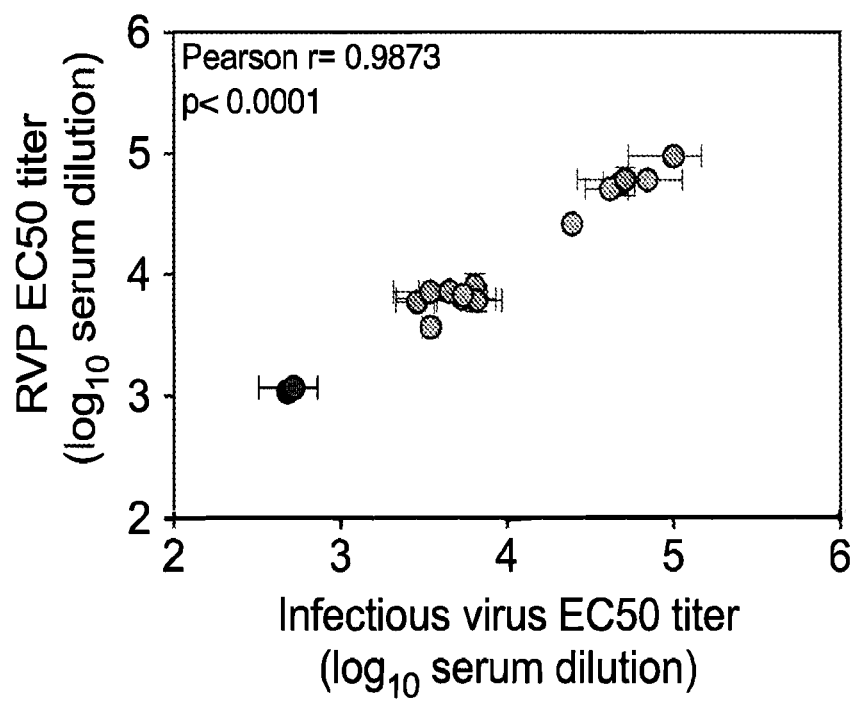

FIGS. 19A & 19B Comparison of Infectious Virus and RVP Neutralization Assays, Related to the Neutralization of ZIKV Reporter Virus Particles by Human Sera Section Within the Results. (A) The ratio of the mean EC50 neutralization titer obtained with both assay formats on Raji DCSIGNR cells was calculated. Each dot represents a comparison of results obtained with a single serum sample and either MR-766 or H/PF/2013 viruses or RVPs. The horizontal line and error bars represent the mean ratio and standard error. (B) The neutralization potency of each serum sample ($EC_{50}$ titer) against ZIKV strain MR-766 (gray circles) or strain H/PF/2013 (black circles) infectious virus and RVPs is plotted on the x- and y-axis, respectively. Error bars reflect the standard error. The correlation between independent measurements was evaluated by Pearson's correlation.

DETAILED DESCRIPTION

This disclosure provides novel Zika virus vaccines, and the use of nucleic acid molecules encoding Zika virus structural proteins, proteins encoded by such nucleic acid molecules, and virus-like particles formed from such proteins, as vaccines for immunizing individuals against infection with Zika virus. Embodiments of the invention comprise a nucleic acid molecule encoding a polyprotein comprising a Zika virus prM protein having a heterologous signal sequence, joined to a Zika virus envelope (E) protein, such that expression of the encoded polyprotein results in the production of virus-like particles capable of inducing an immune response against Zika virus.

It is to be understood that this invention is not limited to the specific embodiments described herein, as such may, of course, vary. It is also to be understood that the terminology used herein is for the purpose of describing particular embodiments only, and is not intended to be limiting, since the scope of the present invention will be limited only by the claims.

Although methods and materials similar or equivalent to those described herein can be used in the practice or testing of the present invention, suitable methods and materials are described below. All publications, patent applications, patents, and other references mentioned herein are incorporated by reference in their entirety. The publications and applications discussed herein are provided solely for their disclosure prior to the filing date of the present application. Nothing herein is to be construed as an admission that the present invention is not entitled to antedate such publication by virtue of prior invention. In addition, the materials, methods, and examples are illustrative only and are not intended to be limiting.

Unless defined otherwise, all technical and scientific terms used herein have the same meaning as is commonly understood by one of skill in art to which the subject matter herein belongs. As used herein, the following definitions are supplied in order to facilitate the understanding of the present invention.

As used herein, the singular forms "a," "an," and "the" include plural referents unless the context clearly dictates otherwise. For example, a nucleic acid molecule refers to one or more nucleic acid molecules. As such, the terms "a", "an", "one or more" and "at least one" can be used interchangeably. The terms "comprising," "including," and "having" can also be used interchangeably. Furthermore, the phrase "selected from the group consisting of" refers to one or more members of the group in the list that follows, including mixtures (i.e. combinations) of two or more members. As used herein, "at least one" means one or more. The term "comprise" is generally used in the sense of "including", that is to say "permitting the presence of one or more features or components." Where descriptions of various embodiments use the term comprising, those skilled in the art will understand that in some specific instances, an embodiment can be alternatively described using the transitional phrase "consisting essentially of."

The claims may be drafted to exclude any optional element. As such, this statement is intended to serve as antecedent basis for use of such exclusive terminology as "solely," "only" and the like in connection with the recitation of claim elements, or use of a "negative" limitation. Further, while various embodiments and technical aspects of the invention may appear in separate locations in the specification, it should be clear that combinations of such embodiments and technical aspects are also encompassed by the invention.

The term nucleic acid refers to deoxyribonucleic acid or ribonucleic acid, and polymers thereof, in either single-stranded or double-stranded form. Unless specifically limited, the term encompasses nucleic acids containing known analogues of natural nucleotides which have binding properties similar to the reference nucleic acid and are metabolized in a manner similar to naturally occurring nucleotides. Unless otherwise indicated, a particular nucleic acid sequence also implicitly encompasses conservatively modified variants thereof (e.g., degenerate codon substitutions) and complementary sequences, as well as the sequence explicitly indicated. Specifically, degenerate codon substitutions may be achieved by generating sequences in which the third position of one or more selected (or all) codons is substituted with mixed-base and/or deoxyinosine residues (Batzer et al. (1991) Nucleic Acid Res 19:5081; Ohtsuka et al. (1985) J Biol Chem 260:2605-2608; Cassol et al. (1992); Rossolini et al. (1994) Mol Cell Probes 8:91-98).

As used herein, a polyprotein is a protein that, after synthesis, is cleaved by enzymes to produce two or more functionally distinct proteins. For example, the entire genome of Zika virus is translated into a polyprotein, which is then processed co- and post-translationally into the individual structural and non-structural proteins.

As used herein, a fusion protein is a recombinant protein containing amino acid sequences from at least two unrelated proteins that have been joined together, via a peptide bond, to make a single protein. The unrelated amino acid sequences can be joined directly to each other or they can be joined using a linker sequence. As used herein, proteins are unrelated, if their amino acid sequences are not normally found joined together via a peptide bond in their natural environment(s) (e.g., inside a cell). For example, heterologous sequences are not normally found in nature joined together via a peptide bond. As a more specific example, the signal sequence from a Japanese Encephalitis Virus prM protein is not normally found in the prM protein from Zika virus. However, such a construct can be recombinantly produced by the hand of man.

The term heterologous is a relative term and is used when comparing the origin of at least two individual molecules (i.e., DNA, RNA, protein, etc.). As used herein, the term heterologous is used to describe at least two different molecules as being from different organisms of different species. For example, the envelope protein of Dengue virus would be considered heterologous to the envelope protein of Japanese Encephalitis Virus or Zika virus. Likewise, the signal sequence of the Japanese Encephalitis Virus prM protein would be considered heterologous to the signal sequence of the Zika Virus prM protein.

As used herein, a signal sequence, signal peptide, and the like, refers to an amino acid sequence that directs translocation of a protein comprising the signal sequence through a membrane. Signal peptides have a low degree of sequence conservation but often have common structural motifs (Lee et al., Virology, 2000, January; 74(1):24-32). For example, amino acids in the amino terminus region of the signal peptide often contain basic side chains, whereas the central core region is usually rich in apolar amino acids. Moreover, the carboxy terminus region frequently contains amino acids with polar side chains and residues with alpha-helix-breaking properties (proline, glycine, or serine). However, such motifs may vary as evidenced by the flavivirus prM signal sequences, which are nonpolar in their carboxy terminus cleavage regions. Signal peptides also vary in size, but are typically between 5 to 30 contiguous amino acids in length.

Any signal sequence can be used to practice the present invention, as long as the chosen signal sequence is capable of directing translocation of a protein comprising the signal sequence through a membrane. Examples of such membranes include, but are not limited to, nuclear membranes, cell membranes, membranes of the endoplasmic reticulum, and the like. Preferred signal sequences are those from viral structural proteins, and more preferably flavivirus structural proteins. As used herein, a flavivirus structural protein refers to a flavivirus capsid (C) protein, a premembrane (prM), a membrane (M) protein, an envelope (E) protein, or portions of such proteins that are capable of forming virus-like particles (VLPs).

As used herein, the term modified refers to a protein or nucleic acid molecule, the properties of which have been altered by the hand of man so that it differs in sequence and/or structure from the same protein or nucleic acid molecule found in nature. For example, a nucleic acid molecule in which the nucleotide sequence has been altered using recombinant techniques would be considered a modified nucleic acid molecule. Such alterations include, but are not limited to, substitution of one or more nucleotide, deletion of one or more nucleotide, insertion of one or more nucleotide, and incorporation of nucleotide analogues. Likewise, a protein, the sequence of which has been altered by the hand of man, is a modified protein. Such modifications include, but are not limited to, substitution of one or more amino acid, deletion of one or more amino acid, insertion of one or more amino acid, and the like. It should be understood that modified proteins include those proteins in which an entire region has been substituted using a corresponding region from a corresponding protein in another organism. For example, membrane proteins are known to contain sequences that anchor the protein in a membrane. A membrane anchor region of a first protein can be substituted with a membrane anchor region from a second protein. In such a scenario, the resulting hybrid protein would be considered a modified protein.

The terms corresponding, corresponds to, and the like, refer to a structural and/or functional similarity between regions in two or more different proteins. Regions in different proteins are considered to correspond when they perform the same function and/or have nearly identical amino acid sequences and/or three-dimensional structures. For example, the membrane anchor regions of envelope proteins from Zika virus and Dengue virus would be considered to be corresponding regions since they both serve to anchor the envelope protein in the membrane. Corresponding regions of proteins may, but need not, have similar sequences. Moreover, due to sequence variability in corresponding proteins between different species, which may include insertions and deletions of amino acids, corresponding regions may not be present in identical linear locations in the proteins. For example, while the stem region of the Zika virus envelope protein may span amino acids 402 through 445 of the Zika virus envelope protein, it may span amino acids 400 through 443 in the Dengue envelope protein. Similarly, the corresponding region of the West Nile Virus envelope protein might span amino acids 405 through 448. Methods of identifying and comparing corresponding regions of proteins are known to those skilled in the art.

As used herein, the stem region of a flavivirus envelope protein refers to the sequence of amino acids between the ectodomain and the C-terminal transmembrane anchor region of the envelope protein. In Zika virus, this region spans amino acids 402-445 and has the sequence IGKAFEATVRGAKRMAVLGD-TAWDFGSVGGVFNSLGKGIHQIF, represented by SEQ ID NO:6, and encoded by SEQ ID NO:5. The corresponding region in the envelope protein of Japanese Encephalitis Virus also spans amino acids 402-445, and has the sequence LGKAFSTTLKGAQRLAALGDTAWDFGSIGGVFN-SIGKAVHQVF, represented by SEQ ID NO:8, and encoded by SEQ ID NO:7. Using such sequences, one skilled in the art can determine the corresponding region in the envelope protein of any other flavivirus.

As used herein, the transmembrane region of a flavivirus envelope protein refers to the sequence of amino acids starting at the carboxy terminus of the stem region and going until the carboxy terminus of the envelope protein. In Zika virus, this region spans amino acids 446-501 and has the sequence: GAAFKSLFGGMSWFSQILIGTLLVWLGLNT-KNGSIASLTCLALGGVMIFLSTAV SA (SEQ ID NO: 10), encoded by SEQ ID NO:9. The corresponding region in the envelope protein of Japanese Encephalitis Virus also spans amino acids 446-500 and has the sequence GGAFRTLFGGMSWITQGLMGALLLWMGVNARDR-SIALAFLATGGVLVFLATN VHA, (SEQ ID NO:12), encoded by SEQ ID NO:11. Using such sequences, one skilled in the art can determine the corresponding region in the envelope protein of any other flavivirus.

As used herein, the term immunogenic refers to the ability of a specific protein, or a specific region thereof, to elicit an immune response to the specific protein, or to proteins comprising an amino acid sequence having a high degree of identity with the specific protein. According to the present invention, two proteins having a high degree of identity have amino acid sequences at least 85% identical, at least 87% identical, at least 90% identical, at least 92% identical, at least 94% identical, at least 96% identical, at least 98% identical or at least 99% identical.

As used herein, an immune response refers to the development in a subject of a humoral and/or a cellular immune response to a Zika virus structural protein. As used herein, a "humoral immune response" refers to an immune response mediated by antibody molecules, including secretory (IgA) or IgG molecules, while a "cellular immune response" is one mediated by T-lymphocytes and/or other white blood cells. One important aspect of cellular immunity involves an antigen-specific response by cytolytic T-cells ("CTL"s). CTLs have specificity for peptide antigens that are presented in association with proteins encoded by the major histocompatibility complex (MHC) and expressed on the surfaces of cells. CTLs help induce and promote the destruction of intracellular microbes, or the lysis of cells infected with such microbes. Another aspect of cellular immunity involves an antigen-specific response by helper T-cells. Helper T-cells act to help stimulate the function, and focus the activity of, nonspecific effector cells against cells displaying peptide antigens in association with MHC molecules on their surface. A cellular immune response also refers to the production of cytokines, chemokines and other such molecules produced by activated T-cells and/or other white blood cells, including those derived from CD4+ and CD8+T-cells.

An immunological response may be one that stimulates CTLs, and/or the production or activation of helper T-cells. The production of chemokines and/or cytokines may also be stimulated. The vaccine may also elicit an antibody-mediated immune response. Hence, an immunological response may include one or more of the following effects: the production of antibodies (e.g., IgA or IgG) by B-cells; and/or the activation of suppressor, cytotoxic, or helper T-cells and/or T-cells directed specifically to a structural protein present in, or encoded by, the vaccine. These responses may serve to neutralize infectivity, and/or mediate antibody-complement, or antibody dependent cell cytotoxicity (ADCC) to provide protection to an immunized individual. Such responses can be determined using standard immunoassays and neutralization assays, well known in the art.

As used herein, the term infectious applies to virus particles and refers to virus particles that are capable of carrying out at least one round of replication. As defined herein, one round of replication refers to the life cycle of the virus, starting with attachment of the virus to a host cell and ending with budding of newly formed virus from the host cell. This life cycle includes, but is not limited to, the steps of attaching to a cell, entering a cell, cleavage of the polyprotein, fusion of the viral membrane with endosomal membrane, release of viral proteins into the cytoplasm, formation of new viral particles and budding of viral particles from the host cell membrane. Thus, infectious virus particles are virus particles that are capable of attaching to and entering a cell, and successfully producing progeny virus.

As used herein, the term pseudo-infectious refers to virus particles, VLPs, and RVPs of the invention, that are capable of attaching to and entering a cell, but which cannot successfully complete at least one round of replication. As such, virus particles, VLPs, and RVPs are not infectious. Those skilled in the art will appreciate that because such virus particles, VLPs, and RVPs can enter a cell and uncoat (e.g., disassemble its shell), pseudo-infectious virus particles, VLPs, and RVPs are useful for delivering nucleic acid molecules into cells.

As used herein, neutralizing antibodies are antibodies that prevent Zika virus from completing one round of replication. Such antibodies can interfere with any step in the virus life cycle including, but not limited to, the steps of attaching to a cell, entering a cell, cleavage of the polyprotein, fusion of the viral membrane with endosomal membrane, release of viral proteins into the cytoplasm, formation of new viral particles and budding of viral particles from the host cell membrane.

As used herein, broadly neutralizing antibodies are antibodies that neutralize more than one strain of Zika virus. For example, broadly neutralizing antibodies elicited against an Asian strain of Zika virus may neutralize an African strain of Zika virus. As a further example, broadly neutralizing antibodies elicited against the EC Yap Micronesia (2007) stain of Zika virus may neutralize the FSS13025 Cambodian (2010) strain of Zika virus.

Nucleic Acid Molecules

One embodiment provides a nucleic acid molecule encoding a polyprotein comprising a signal sequence joined to at least a portion of a Zika virus prM protein, which is joined to at least a portion of a Zika virus envelope (E) protein, wherein the signal sequence is heterologous to Zika virus. Any signal sequence may be joined to the at least a portion of a Zika virus prM protein, as long as it is heterologous to Zika virus, and as long as it is able to direct translocation of the polyprotein. The signal sequence may be from a viral protein, a bacterial protein, or a mammalian protein. Examples of signal sequences useful for practicing the invention are provided in the following Table:

TABLE 1

Exemplary sequences useful for practicing the invention

| SEQ ID NO: | Molecule | Comments |
|---|---|---|
| 1 | Nucleic acid | Sequence encoding Zika virus prM protein |
| 2 | Protein | Protein encoded by SEQ ID NO: 1 |
| 3 | Nucleic acid | Sequence encoding Zika virus E protein |
| 4 | Protein | Protein encoded by SEQ ID NO: 2 |
| 5 | Nucleic acid | Sequence encoding stem region of Zika virus E protein |
| 6 | Protein | Translation of SEQ ID NO: 5 |
| 7 | NAM | Sequence encoding stem region of Japanese Encephalitis virus E protein |
| 8 | Protein | Amino acid sequence of Japanese Encephalitis virus stem region |
| 9 | Nucleic acid | Sequence encoding transmembrane region of Zika virus E protein |
| 10 | Protein | Translation of SEQ ID NO: 9 |
| 11 | NAM | Nucleic acid sequence encoding Japanese Encephalitis virus transmembrane domain |
| 12 | Protein | Amino acid sequence of Japanese Encephalitis virus transmembrane domain |
| 13 | NAM | Nucleic acid sequence encoding Zika virus stem/transmembrane region |
| 14 | Protein | Amino acid sequence of Zika virus stem/transmembrane region |
| 15 | NAM | Nucleic acid sequence encoding Japanese Encephalitis virus stem/transmembrane region |
| 16 | Protein | Amino acid sequence of Japanese Encephalitis virus stem/transmembrane region |
| 17 | NAM | Nucleic acid sequence encoding signal sequence from Japanese encephalitis virus prM |
| 18 | Protein | Amino acid sequence encoded by SEQ ID NO: 17 |
| 19 | NAM | Nucleic acid sequence encoding signal sequence human CD5 protein |
| 20 | Protein | Amino acid sequence encoded by SEQ ID NO: 19 |
| 21 | NAM | Nucleic acid sequence encoding signal sequence from Zika virus prM |
| 22 | Protein | Amino acid sequence encoded by SEQ ID NO: 19 (Zika prM signal sequence) |
| 23 | NAM | Nucleic acid molecule encoding signal sequence from mouse IL-2 |
| 24 | Protein | Signal sequence from IL-2 |
| 25 | NAM | Nucleic acid molecule encoding signal sequence from bovine prolactin |
| 26 | Protein | Signal sequence from bovine prolactin |
| 27 | Protein | Precursor peptide from Zika virus prM protein |
| 28 | Protein | Zika virus membrane protein after removal of precursor peptide |

The signal sequence may be from a flavivirus protein, which may be a protein from a flavivirus selected from the group consisting of Dengue virus, Japanese Encephalitis Virus, Murray Valley Encephalitis Virus, St. Louis Encephalitis Virus, West Nile Virus, and Yellow Fever Virus. In one embodiment, the signal sequence is from a flavivirus prM protein, which may be the prM protein of a flavivirus selected from the group consisting of Dengue virus, Japanese Encephalitis Virus, Murray Valley Encephalitis Virus, St. Louis Encephalitis Virus, West Nile Virus, and Yellow Fever Virus. In one embodiment, the signal sequence is from the prM protein of a Japanese Encephalitis Virus. In one embodiment, the signal sequence is from a mammalian CD5 protein. In one embodiment, the signal sequence is from a CD5 protein from a mouse or human. In one embodiment, the signal sequence is from interleukin-2 (IL-2). In one embodiment, the signal sequence is from bovine prolactin.

Nucleic acid molecules of the invention may encode proteins comprising variants of signal sequences or variants of Zika virus structural proteins. As used herein, a "variant" refers to a protein or nucleic acid molecule, the sequence of which is similar, but not identical to, a reference sequence, wherein the activity of the variant protein (or the protein encoded by the variant nucleic acid molecule) is not significantly altered. These variations in sequence can be naturally occurring variations or they can be engineered through the use of genetic engineering techniques known to those skilled in the art. Examples of such techniques are found in Sambrook, Fritsch, Maniatis, et al., in Molecular Cloning—A Laboratory Manual, 2nd Edition, Cold Spring Harbor Laboratory Press, 1989, pp. 9.31-9.57), or in Current Protocols in Molecular Biology, John Wiley & Sons, N.Y. (1989), 6.3.1-6.3.6, both of which are incorporated herein by reference in their entirety.

With regard to variants, any type of alteration in the amino acid, or nucleic acid, sequence is permissible so long as the resulting variant protein retains the desired activity (e.g., the ability to direct translocation or to elicit an immune response). Examples of such variations include, but are not limited to, deletions, insertions, substitutions, and combinations thereof. For example, with regard to proteins, it is well understood by those skilled in the art that one or more amino acids can often be removed from the amino and/or carboxy terminus of a protein without significantly affecting the activity of that protein. Similarly, one or more amino acids can be inserted into a protein without significantly affecting the activity of the protein.

As noted, variant proteins encoded by nucleic acid molecules of the present invention can contain amino acid substitutions relative to the proteins disclosed herein. Any amino acid substitution is permissible as long as the desired activity of the protein is not significantly affected. In this regard, amino acids can be classified into groups based on their physical properties. Examples of such groups include, but are not limited to, charged amino acids, uncharged amino acids, polar uncharged amino acids, and hydrophobic amino acids. Preferred variants that contain substitutions are those in which an amino acid is substituted with an amino acid from the same group. Such substitutions are referred to as conservative substitutions.

Naturally occurring residues may be divided into classes based on common side chain properties:

1) hydrophobic: Met, Ala, Val, Leu, Ile;
2) neutral hydrophilic: Cys, Ser, Thr;
3) acidic: Asp, Glu;
4) basic: Asn, Gln, His, Lys, Arg;
5) residues that influence chain orientation: Gly, Pro; and
6) aromatic: Trp, Tyr, Phe.

For example, non-conservative substitutions may involve the exchange of a member of one of these classes for a member from another class.

In making amino acid changes, the hydropathic index of amino acids may be considered. Each amino acid has been assigned a hydropathic index on the basis of its hydrophobicity and charge characteristics. The hydropathic indices are: isoleucine (+4.5); valine (+4.2); leucine (+3.8); phenylalanine (+2.8); cysteine/cystine (+2.5); methionine (+1.9); alanine (+1.8); glycine (−0.4); threonine (−0.7); serine (−0.8); tryptophan (−0.9); tyrosine (−1.3); proline (−1.6); histidine (−3.2); glutamate (−3.5); glutamine (−3.5); aspartate (−3.5); asparagine (−3.5); lysine (−3.9); and arginine (−4.5). The importance of the hydropathic amino acid index in conferring interactive biological function on a protein is generally understood in the art (Kyte et al., 1982, J. Mol. Biol. 157:105-31). It is known that certain amino acids may be substituted for other amino acids having a similar hydropathic index or score and still retain a similar biological activity. In making changes based upon the hydropathic index, the substitution of amino acids whose hydropathic indices are within ±2 is preferred, those within ±1 are particularly preferred, and those within ±0.5 are even more particularly preferred.

The substitution of like amino acids may also be made effectively on the basis of hydrophilicity, particularly where the biologically functionally equivalent protein or peptide thereby created is intended for use in immunological inventions, as in the present case. The greatest local average hydrophilicity of a protein, as governed by the hydrophilicity of its adjacent amino acids, correlates with its immunogenicity and antigenicity, i.e., with a biological property of the protein. The following hydrophilicity values have been assigned to these amino acid residues: arginine (+3.0); lysine (+3.0); aspartate (+3.0±1); glutamate (+3.0±1); serine (+0.3); asparagine (+0.2); glutamine (+0.2); glycine (0); threonine (−0.4); proline (−0.5±1); alanine (−0.5); histidine (−0.5); cysteine (−1.0); methionine (−1.3); valine (−1.5); leucine (−1.8); isoleucine (−1.8); tyrosine (−2.3); phenylalanine (−2.5); and tryptophan (−3.4). In making changes based upon similar hydrophilicity values, the substitution of amino acids whose hydrophilicity values are within ±2 is preferred, those within ±1 are particularly preferred, and those within ±0.5 are even more particularly preferred. One may also identify epitopes from primary amino acid sequences on the basis of hydrophilicity.

Desired amino acid substitutions (whether conservative or non-conservative) can be determined by those skilled in the art at the time such substitutions are desired. For example, amino acid substitutions can be used to identify important residues of the structural protein, or to increase or decrease the immunogenicity, solubility or stability of the Zika virus structural proteins described herein. Exemplary amino acid substitutions are shown below in Table 2:

TABLE 2

Exemplary Amino Acid Substitutions
Amino Acid Substitutions

| Original Amino Acid | Exemplary Substitutions |
|---|---|
| Ala | Val, Leu, Ile |
| Arg | Lys, Gln, Asn |
| Asn | Gln |
| Asp | Glu |
| Cys | Ser, Ala |
| Gln | Asn |
| Glu | Asp |
| Gly | Pro, Ala |
| His | Asn, Gln, Lys, Arg |
| Ile | Leu, Val, Met, Ala |
| Leu | Ile, Val, Met, Ala |
| Lys | Arg, Gln, Asn |
| Met | Leu, Phe, Ile |
| Phe | Leu, Val, Ile, Ala, Tyr |
| Pro | Ala |

TABLE 2-continued

Exemplary Amino Acid Substitutions
Amino Acid Substitutions

| Original Amino Acid | Exemplary Substitutions |
|---|---|
| Ser | Thr, Ala, Cys |
| Thr | Ser |
| Trp | Tyr, Phe |
| Tyr | Trp, Phe, Thr, Ser |
| Val | Ile, Met, Leu, Phe, Ala |

As used herein, the phrase "significantly affect a proteins' activity" refers to a decrease in the activity of a protein by at least 10%, at least 20%, at least 30%, at least 40% or at least 50%. Such an activity may be measured, for example, as the ability of a protein to direct translocation, form VLPs and/or to elicit an immune response (e.g., antibodies) against Zika virus. Such activity may be measured by determining the titer of such antibodies against Zika virus, or by measuring the breadth of Zika virus strains neutralized by the elicited antibodies. Methods of determining the above-recited activities are known to those skilled in the relevant arts.

In one embodiment, the signal sequence comprises an amino acid sequence at least 90% identical, at least 95% identical, or at least 97% identical to the signal sequence of a flavivirus protein. In one embodiment, the signal sequence comprises an amino acid sequence at least 90% identical, at least 95% identical, or at least 97% identical to the signal sequence of a protein from a flavivirus selected from the group consisting of Dengue virus, Japanese Encephalitis Virus, Murray Valley Encephalitis Virus, St. Louis Encephalitis Virus, West Nile Virus, and Yellow Fever Virus. In one embodiment, the signal sequence comprises an amino acid sequence at least 90% identical, at least 95% identical, or at least 97% identical to the signal sequence of a flavivirus prM protein. In one embodiment, the signal sequence comprises an amino acid sequence at least 90% identical, at least 95% identical, or at least 97% identical to the signal sequence of prM protein from a flavivirus selected from the group consisting of Dengue virus, Japanese Encephalitis Virus, Murray Valley Encephalitis Virus, St. Louis Encephalitis Virus, West Nile Virus, and Yellow Fever Virus. In one embodiment, the signal sequence is at least 90% identical, at least 95% identical, or at least 97% identical to the signal sequence of the prM protein of Japanese Encephalitis Virus. In one embodiment, the signal sequence comprises the amino acid sequence of the signal sequence of the prM protein of Japanese Encephalitis Virus.

In one embodiment, the signal sequence is at least 90% identical, at least 95% identical, or at least 97% identical to the signal sequence of a CD5 protein. In one embodiment, the signal sequence is at least 90% identical, at least 95% identical, or at least 97% identical to the signal sequence of a human CD5 protein. In one embodiment, the signal sequence is at least 90% identical, at least 95% identical, or at least 97% identical to the signal sequence of a murine CD5 protein.

In one embodiment, the signal sequence comprises an amino acid sequence at least 90% identical, at least 95% identical, or at least 97% identical to SEQ ID NO:18. In one embodiment, the signal sequence comprises SEQ ID NO:18. In one embodiment, the signal sequence is encoded by a nucleic acid sequence at least 90% identical, at least 95% identical, or at least 97% identical to SEQ ID NO:17. In one embodiment, the signal sequence is encoded by a nucleic acid sequence comprising SEQ ID NO:17. In one embodiment, the signal sequence comprises an amino acid sequence at least 90% identical, at least 95% identical, or at least 97% identical to SEQ ID NO:20. In one embodiment, the signal sequence comprises SEQ ID NO:20. In one embodiment, the signal sequence is encoded by a nucleic acid sequence at least 90% identical, at least 95% identical, or at least 97% identical to SEQ ID NO:19. In one embodiment, the signal sequence is encoded by a nucleic acid sequence comprising SEQ ID NO:19. In one embodiment, the signal sequence comprises an amino acid sequence at least 90% identical, at least 95% identical, or at least 97% identical to SEQ ID NO:24. In one embodiment, the signal sequence comprises SEQ ID NO:24. In one embodiment, the signal sequence is encoded by a nucleic acid sequence at least 90% identical, at least 95% identical, or at least 97% identical to SEQ ID NO:23. In one embodiment, the signal sequence is encoded by a nucleic acid sequence comprising SEQ ID NO:23. In one embodiment, the signal sequence comprises an amino acid sequence at least 90% identical, at least 95% identical, or at least 97% identical to SEQ ID NO:26. In one embodiment, the signal sequence comprises SEQ ID NO:26. In one embodiment, the signal sequence is encoded by a nucleic acid sequence at least 90% identical, at least 95% identical, or at least 97% identical to SEQ ID NO:25. In one embodiment, the signal sequence is encoded by a nucleic acid sequence comprising SEQ ID NO:25.

In one embodiment, the nucleic acid molecule comprises a nucleic acid sequence encoding an amino acid sequence at least 90% identical, at least 95% identical, at least 97% identical, at least 99% identical, or 100% identical, to SEQ ID NO:18. In one embodiment, the nucleic acid molecule comprises a nucleic acid sequence at least 90% identical, at least 95% identical, at least 97% identical, at least 99%, or 100% identical, to SEQ ID NO:17. In one embodiment, the nucleic acid molecule comprises a nucleic acid sequence encoding an amino acid sequence at least 90% identical, at least 95% identical, at least 97% identical, at least 99% identical, or 100% identical, to SEQ ID NO:20. In one embodiment, the nucleic acid molecule comprises a nucleic acid sequence at least 90% identical, at least 95% identical, at least 97% identical, at least 99%, or 100% identical, to SEQ ID NO:19. In one embodiment, the nucleic acid molecule comprises a nucleic acid sequence encoding an amino acid sequence at least 90% identical, at least 95% identical, at least 97% identical, at least 99% identical, or 100% identical, to SEQ ID NO:24. In one embodiment, the nucleic acid molecule comprises a nucleic acid sequence at least 90% identical, at least 95% identical, at least 97% identical, at least 99%, or 100% identical, to SEQ ID NO:23. In one embodiment, the nucleic acid molecule comprises a nucleic acid sequence encoding an amino acid sequence at least 90% identical, at least 95% identical, at least 97% identical, at least 99% identical, or 100% identical, to SEQ ID NO:26. In one embodiment, the nucleic acid molecule comprises a nucleic acid sequence at least 90% identical, at least 95% identical, at least 97% identical, at least 99%, or 100% identical, to SEQ ID NO:25.

As noted, the polyprotein comprises at least a portion of a Zika virus prM protein joined to at least a portion of a Zika virus envelope protein. As used herein, a portion refers to at least 20 amino acids that are contiguous in the referenced Zika virus protein. It will be understood that portions greater than 20 contiguous amino acids can be used in embodiments of the invention, as long as the resulting construct encodes a protein capable of inducing an immune response against Zika virus, and/or capable of forming virus-like particles (VLPs) that induce an immune response against Zika virus. Preferred portions are those capable of forming virus-like particles (VLPs). As used herein, a virus-like particle (VLP) is a particle that is formed from the self-assembly of one or more viral structural proteins, but which lacks a sufficient portion of the viral genome so that, upon entry into a cell, the VLP cannot produce progeny virus particles. While VLPs may contain some genetic material, preferred particles to be used as vaccines are those lacking genetic material. VLPs of the invention may, but need not, have a three-dimensional structure similar to a native Zika virus particle. Preferred VLPs of the invention are those in which the VLPs display the Zika virus proteins comprised therein in such a manner that administration of the VLPs to an individual result in elucidation of an immune response against Zika virus.

One type of VLP of the invention is a reporter virus particle (RPV). Reporter virus particles are pseudo-infectious flaviviruses produced by encapsidation of a self-replicating, sub-genomic, flavivirus nucleic acid molecule by flavivirus structural proteins provided in trans. Thus, RPVs are capable of binding to and entering a cell, but because they lack the full flavivirus genome, they cannot produce progeny virus. The self-replicating, sub-genomic, flavivirus nucleic acid molecule encodes a reporter molecule, thereby allowing the tracking and detection of the RVP. The production of reporter virus particles is known to those skilled in the art and is also disclosed in U.S. Pat. No. 8,691,961, which is incorporated herein by reference in its entirety. Reporter virus particles of the invention can comprise structural proteins disclosed herein.

In one embodiment, the at least a portion of a Zika virus prM protein comprises at least 25 contiguous amino acids, at least 50 contiguous amino acids, at least 100 contiguous amino acids, at least 125 contiguous amino acids, or at least 150 contiguous amino acids, from a Zika virus prM protein. In one embodiment, the at least a portion of a Zika virus prM protein comprises at least 25 contiguous amino acids, at least 50 contiguous amino acids, at least 100 contiguous amino acids, at least 125 contiguous amino acids, or at least 150 contiguous amino acids, from SEQ ID NO:2. In one embodiment, the at least a portion of a Zika virus prM protein comprises at least 25 contiguous amino acids, at least 50 contiguous amino acids, at least 100 contiguous amino acids, at least 125 contiguous amino acids, or at least 150 contiguous amino acids, from a protein encoded by a nucleic acid sequence comprising SEQ ID NO:1. In one embodiment, the at least a portion of a Zika virus prM protein comprises a Zika virus prM protein. In one embodiment, the at least a portion of a Zika virus prM protein comprises SEQ ID NO:2. In one embodiment, the at least a portion of a Zika virus prM protein consists of SEQ ID NO:2.

In one embodiment, the at least a portion of a Zika virus prM protein is encoded by a nucleic acid sequence comprising at least 75 contiguous nucleotides, at least 150 contiguous nucleotides, at least 300 contiguous nucleotides, at least 375 contiguous nucleotides, or at least 450 contiguous nucleotides from a polynucleotide sequence encoding a Zika virus prM protein. In one embodiment, the at least a portion of a Zika virus prM protein is encoded by a nucleic acid sequence comprising at least 75 contiguous nucleotides, at least 150 contiguous nucleotides, at least 300 contiguous nucleotides, at least 375 contiguous nucleotides, or at least 450 contiguous nucleotides from a polynucleotide sequence encoding a protein comprising SEQ ID NO:2. In one embodiment, the at least a portion of a Zika virus prM protein is encoded by a nucleic acid sequence comprising at least 75 contiguous nucleotides, at least 150 contiguous nucleotides, at least 300 contiguous nucleotides, at least 375 contiguous nucleotides, or at least 450 contiguous nucleotides from SEQ ID NO:1. In one embodiment, the at least a portion of a Zika virus prM protein is encoded by SEQ ID NO:1.

In one embodiment, the nucleic acid molecule comprises a nucleic acid sequence encoding a protein comprising at least 25 contiguous amino acids, at least 50 contiguous amino acids, at least 100 contiguous amino acids, at least 125 contiguous amino acids, or at least 150 contiguous amino acids, from a Zika virus prM protein. In one embodiment, the nucleic acid molecule comprises a nucleic acid sequence encoding a protein comprising at least 25 contiguous amino acids, at least 50 contiguous amino acids, at least 100 contiguous amino acids, at least 125 contiguous amino acids, or at least 150 contiguous amino acids, from SEQ ID NO:2. In one embodiment, the nucleic acid molecule comprises at least 75 contiguous nucleotides, at least 150 contiguous nucleotides, at least 300 contiguous nucleotides, at least 375 contiguous nucleotides, or at least 450 contiguous nucleotides from a polynucleotide sequence encoding a Zika virus prM protein. In one embodiment, the nucleic acid molecule comprises at least 75 contiguous nucleotides, at least 150 contiguous nucleotides, at least 300 contiguous nucleotides, at least 375 contiguous nucleotides, or at least 450 contiguous nucleotides from a polynucleotide sequence encoding a protein comprising SEQ ID NO:2. In one embodiment, the nucleic acid molecule comprises at least 75 contiguous nucleotides, at least 150 contiguous nucleotides, at least 300 contiguous nucleotides, at least 375 contiguous nucleotides, or at least 450 contiguous nucleotides from SEQ ID NO:1. In one embodiment, the nucleic acid molecule comprises SEQ ID NO:1.

In one embodiment, the at least a portion of a Zika virus envelope protein comprises at least 25 contiguous amino acids, at least 50 contiguous amino acids, at least 100 contiguous amino acids, at least 125 contiguous amino acids, at least 150 contiguous amino acids, at least 200 contiguous amino acids, at least 250 contiguous amino acids, at least 300 contiguous amino acids at least 350 contiguous amino acids, at least 400 contiguous amino acids, at least 450 contiguous amino acids, or at least 500 contiguous amino acids, from a Zika virus envelope protein. In one embodiment, the at least a portion of a Zika virus envelope protein comprises at least 25 contiguous amino acids, at least 50 contiguous amino acids, at least 100 contiguous amino acids, at least 125 contiguous amino acids, at least 150 contiguous amino acids, at least 200 contiguous amino acids, at least 250 contiguous amino acids, at least 300 contiguous amino acids at least 350 contiguous amino acids, at least 400 contiguous amino acids, at least 450 contiguous amino acids, or at least 500 contiguous amino acids, from SEQ ID NO:4. In one embodiment, the polyprotein comprises a Zika virus envelope protein. In one embodiment, the at least a portion of a Zika virus envelope protein comprises at least 25 contiguous amino acids, at least 50 contiguous amino acids, at least 100 contiguous amino acids, at least 125 contiguous amino acids, at least 150 contiguous amino acids, at least 200 contiguous amino acids, at least 250 contiguous amino acids, at least 300 contiguous amino acids at least 350 contiguous amino acids, at least 400 contiguous amino acids, at least 450 contiguous amino acids, or at least 500 contiguous amino acids, from a protein encoded by SEQ ID NO:3. In one embodiment, the at least a portion of a Zika virus envelope protein comprises a full-length Zika virus envelope protein. In one embodiment, the at least a portion of the Zika virus envelope protein comprises SEQ ID NO:4.

In one embodiment, the at least a portion of a Zika virus envelope protein is encoded by a nucleic acid sequence comprising at least 75 contiguous nucleotides, at least 150 contiguous nucleotides, at least 300 contiguous nucleotides, at least 375 contiguous nucleotides, at least 450 contiguous nucleotides, at least 600 contiguous nucleotides, at least 750 contiguous nucleotides, at least 900 contiguous nucleotides, at least 1050 contiguous nucleotides, at least 1200 contiguous nucleotides, at least 1350 contiguous nucleotides, or at least 1500 contiguous nucleotides, from a polynucleotide sequence encoding a Zika virus envelope protein. In one embodiment, the at least a portion of a Zika virus envelope protein is encoded by a nucleic acid sequence comprising at least 75 contiguous nucleotides, at least 150 contiguous nucleotides, at least 300 contiguous nucleotides, at least 375 contiguous nucleotides, at least 450 contiguous nucleotides, at least 600 contiguous nucleotides, at least 750 contiguous nucleotides, at least 900 contiguous nucleotides, at least 1050 contiguous nucleotides, at least 1200 contiguous nucleotides, at least 1350 contiguous nucleotides, or at least 1500 contiguous nucleotides, from a polynucleotide sequence encoding a protein comprising SEQ ID NO:4. In one embodiment, the at least a portion of a Zika virus envelope protein is encoded by a nucleic acid sequence comprising at least 75 contiguous nucleotides, at least 150 contiguous nucleotides, at least 300 contiguous nucleotides, at least 375 contiguous nucleotides, at least 450 contiguous nucleotides, at least 600 contiguous nucleotides, at least 750 contiguous nucleotides, at least 900 contiguous nucleotides, at least 1050 contiguous nucleotides, at least 1200 contiguous nucleotides, at least 1350 contiguous nucleotides, or at least 1500 contiguous nucleotides from SEQ ID NO:3. In one embodiment, the at least a portion of a Zika virus envelope protein is encoded by SEQ ID NO:3.

In one embodiment, the nucleic acid molecule comprises a nucleic acid sequence encoding a protein comprising at least 25 contiguous amino acids, at least 50 contiguous amino acids, at least 100 contiguous amino acids, at least 125 contiguous amino acids, at least 150 contiguous amino acids, at least 200 contiguous amino acids, at least 250 contiguous amino acids, at least 300 contiguous amino acids at least 350 contiguous amino acids, at least 400 contiguous amino acids, at least 450 contiguous amino acids, or at least 500 contiguous amino acids, from a Zika virus envelope protein. In one embodiment, the nucleic acid molecule comprises a nucleic acid sequence encoding a protein comprising at least 25 contiguous amino acids, at least 50 contiguous amino acids, at least 100 contiguous amino acids, at least 125 contiguous amino acids, at least 150 contiguous amino acids, at least 200 contiguous amino acids, at least 250 contiguous amino acids, at least 300 contiguous amino acids at least 350 contiguous amino acids, at least 400 contiguous amino acids, at least 450 contiguous amino acids, or at least 500 contiguous amino acids, from SEQ ID NO:4. In one embodiment, the nucleic acid molecule comprises a nucleic acid sequence encoding a protein comprising at least 25 contiguous amino acids, at least 50 contiguous amino acids, at least 100 contiguous amino acids, at least 125 contiguous amino acids, at least 150 contiguous amino acids, at least 200 contiguous amino acids, at least 250 contiguous amino acids, at least 300 contiguous amino acids at least 350 contiguous amino acids, at least 400 contiguous amino acids, at least 450 contiguous amino acids, or at least 500 contiguous amino acids, from a protein encoded by SEQ ID NO:3.

In one embodiment, the nucleic acid molecule comprises a nucleic acid sequence comprising at least 75 contiguous nucleotides, at least 150 contiguous nucleotides, at least 300 contiguous nucleotides, at least 375 contiguous nucleotides, at least 450 contiguous nucleotides, at least 600 contiguous nucleotides, at least 750 contiguous nucleotides, at least 900 contiguous nucleotides, at least 1050 contiguous nucleotides, at least 1200 contiguous nucleotides, at least 1350 contiguous nucleotides, or at least 1500 contiguous nucleotides from a polynucleotide sequence encoding a Zika virus envelope protein. In one embodiment, the nucleic acid molecule comprises a nucleic acid sequence comprising at least 75 contiguous nucleotides, at least 150 contiguous nucleotides, at least 300 contiguous nucleotides, at least 375 contiguous nucleotides, at least 450 contiguous nucleotides, at least 600 contiguous nucleotides, at least 750 contiguous nucleotides, at least 900 contiguous nucleotides, at least 1050 contiguous nucleotides, at least 1200 contiguous nucleotides, at least 1350 contiguous nucleotides, or at least 1500 contiguous nucleotides from a polynucleotide sequence encoding a protein comprising SEQ ID NO:4. In one embodiment, the nucleic acid molecule comprises a nucleic acid sequence comprising at least 75 contiguous nucleotides, at least 150 contiguous nucleotides, at least 300 contiguous nucleotides, at least 375 contiguous nucleotides, at least 450 contiguous nucleotides, at least 600 contiguous nucleotides, at least 750 contiguous nucleotides, at least 900 contiguous nucleotides, at least 1050 contiguous nucleotides, at least 1200 contiguous nucleotides, at least 1350 contiguous nucleotides, or at least 1500 contiguous nucleotides from SEQ ID NO:3.

In one embodiment, the at least a portion of a Zika virus prM is a variant of a Zika virus wild-type Zika virus prM protein. In preferred embodiments, such variants are capable of forming VLPs and/or eliciting an immune response against Zika virus. In one embodiment, the at least a portion of a Zika virus prM protein comprises at least at least 25 contiguous amino acids, at least 50 contiguous amino acids, at least 100 contiguous amino acids, at least 125 contiguous amino acids, or at least 150 contiguous amino acids, having a sequence at least 80%, at least 85%, at least 90%, at least 95%, at least 97% identical, or at least 99% identical to at least 25 contiguous amino acids, at least 50 contiguous amino acids, at least 100 contiguous amino acids, at least 125 contiguous amino acids, or at least 150 contiguous amino acids, from a Zika virus prM protein. In one embodiment, the at least a portion of a Zika virus prM protein comprises at least at least 25 contiguous amino acids, at least 50 contiguous amino acids, at least 100 contiguous amino acids, at least 125 contiguous amino acids, or at least 150 contiguous amino acids, having a sequence at least 80%, at least 85%, at least 90%, at least 95%, at least 97% identical, or at least 99% identical to at least 25 contiguous amino acids, at least 50 contiguous amino acids, at least 100 contiguous amino acids, at least 125 contiguous amino acids, or at least 150 contiguous amino acids, from a protein encoded by SEQ ID NO:1. In one embodiment, the at least a portion of a Zika virus prM protein comprises at least at least 25 contiguous amino acids, at least 50 contiguous amino acids, at least 100 contiguous amino acids, at least 125 contiguous amino acids, or at least 150 contiguous amino acids, having a sequence at least 80%, at least 85%, at least 90%, at least 95%, at least 97% identical, or at least 99% identical to at least 25 contiguous amino acids, at least 50 contiguous amino acids, at least 100 contiguous amino acids, at least 125 contiguous amino acids, or at least 150 contiguous amino acids, from a protein comprising SEQ ID NO:2.

In one embodiment, the nucleic acid molecule comprises a nucleic acid sequence encoding the at least a portion of a variant Zika virus prM. In one embodiment, the nucleic acid molecule comprises a nucleic acid sequence encoding at least at least 25 contiguous amino acids, at least 50 contiguous amino acids, at least 100 contiguous amino acids, at least 125 contiguous amino acids, or at least 150 contiguous amino acids, having a sequence at least 80%, at least 85%, at least 90%, at least 95%, at least 97% identical, or at least 99% identical to at least 25 contiguous amino acids, at least 50 contiguous amino acids, at least 100 contiguous amino acids, at least 125 contiguous amino acids, or at least 150 contiguous amino acids, from a Zika virus prM protein. In one embodiment, the nucleic acid molecule comprises a nucleic acid sequence encoding at least at least 25 contiguous amino acids, at least 50 contiguous amino acids, at least 100 contiguous amino acids, at least 125 contiguous amino acids, or at least 150 contiguous amino acids, having a sequence at least 80%, at least 85%, at least 90%, at least 95%, at least 97% identical, or at least 99% identical to at least 25 contiguous amino acids, at least 50 contiguous amino acids, at least 100 contiguous amino acids, at least 125 contiguous amino acids, or at least 150 contiguous amino acids, from a protein encoded by SEQ ID NO:1. In one embodiment, the nucleic acid molecule comprises a nucleic acid sequence encoding at least at least 25 contiguous amino acids, at least 50 contiguous amino acids, at least 100 contiguous amino acids, at least 125 contiguous amino acids, or at least 150 contiguous amino acids, having a sequence at least 80%, at least 85%, at least 90%, at least 95%, at least 97% identical, or at least 99% identical to at least 25 contiguous amino acids, at least 50 contiguous amino acids, at least 100 contiguous amino acids, at least 125 contiguous amino acids, or at least 150 contiguous amino acids, from a protein comprising SEQ ID NO:2.

In one embodiment, the at least a portion of a Zika virus envelope is a variant of a Zika virus wild-type envelope protein. In preferred embodiments, such variants are capable of forming VLPs and/or eliciting an immune response against Zika virus. In one embodiment, the at least a portion of a Zika virus envelope protein comprises at least 25 contiguous amino acids, at least 50 contiguous amino acids, at least 100 contiguous amino acids, at least 125 contiguous amino acids, at least 150 contiguous amino acids, at least 200 contiguous amino acids, at least 250 contiguous amino acids, at least 300 contiguous amino acids at least 350 contiguous amino acids, at least 400 contiguous amino acids, at least 450 contiguous amino acids, or at least 500 contiguous amino acids, having a sequence at least 80% identical, at least 85% identical, at least 90% identical, at least 95% identical, at least 97% identical, or at least 99% identical, to at least 25 contiguous amino acids, at least 50 contiguous amino acids, at least 100 contiguous amino acids, at least 125 contiguous amino acids, at least 150 contiguous amino acids, at least 200 contiguous amino acids, at least 250 contiguous amino acids, at least 300 contiguous amino acids at least 350 contiguous amino acids, at least 400 contiguous amino acids, at least 450 contiguous amino acids, or at least 500 contiguous amino acids, from a Zika virus envelope protein. In one embodiment, the at least a portion of a Zika virus envelope protein comprises at least 25 contiguous amino acids, at least 50 contiguous amino acids, at least 100 contiguous amino acids, at least 125 contiguous amino acids, at least 150 contiguous amino acids, at least 200 contiguous amino acids, at least 250 contiguous amino acids, at least 300 contiguous amino acids at least 350 contiguous amino acids, at least 400 contiguous amino acids, at least 450 contiguous amino acids, or at least 500 contiguous amino acids, having a sequence at least 80% identical, at least 85% identical, at least 90% identical, at least 95% identical, at least 97% identical, or at least 99% identical, to at least 25 contiguous amino acids, at least 50 contiguous amino acids, at least 100 contiguous amino acids, at least 125 contiguous amino acids, at least 150 contiguous amino acids, at least 200 contiguous amino acids, at least 250 contiguous amino acids, at least 300 contiguous amino acids at least 350 contiguous amino acids, at least 400 contiguous amino acids, at least 450 contiguous amino acids, or at least 500 contiguous amino acids, from SEQ ID NO:4. In one embodiment, the at least a portion of a Zika virus envelope protein comprises at least 25 contiguous amino acids, at least 50 contiguous amino acids, at least 100 contiguous amino acids, at least 125 contiguous amino acids, at least 150 contiguous amino acids, at least 200 contiguous amino acids, at least 250 contiguous amino acids, at least 300 contiguous amino acids at least 350 contiguous amino acids, at least 400 contiguous amino acids, at least 450 contiguous amino acids, or at least 500 contiguous amino acids, having a sequence at least 80% identical, at least 85% identical, at least 90% identical, at least 95% identical, at least 97% identical, or at least 99% identical, to at least 25 contiguous amino acids, at least 50 contiguous amino acids, at least 100 contiguous amino acids, at least 125 contiguous amino acids, at least 150 contiguous amino acids, at least 200 contiguous amino acids, at least 250 contiguous amino acids, at least 300 contiguous amino acids at least 350 contiguous amino acids, at least 400 contiguous amino acids, at least 450 contiguous amino acids, or at least 500 contiguous amino acids, from a protein encoded by SEQ ID NO:3.

In one embodiment, the nucleic acid molecule comprises a nucleic acid sequence encoding at least 25 contiguous amino acids, at least 50 contiguous amino acids, at least 100 contiguous amino acids, at least 125 contiguous amino acids, at least 150 contiguous amino acids, at least 200 contiguous amino acids, at least 250 contiguous amino acids, at least 300 contiguous amino acids at least 350 contiguous amino acids, at least 400 contiguous amino acids, at least 450 contiguous amino acids, or at least 500 contiguous amino acids, having a sequence at least 80% identical, at least 85% identical, at least 90% identical, at least 95% identical, at least 97% identical, or at least 99% identical, to at least 25 contiguous amino acids, at least 50 contiguous amino acids, at least 100 contiguous amino acids, at least 125 contiguous amino acids, at least 150 contiguous amino acids, at least 200 contiguous amino acids, at least 250 contiguous amino acids, at least 300 contiguous amino acids at least 350 contiguous amino acids, at least 400 contiguous amino acids, at least 450 contiguous amino acids, or at least 500 contiguous amino acids, from a Zika virus envelope protein. In one embodiment, the nucleic acid molecule comprises a nucleic acid sequence encoding at least 25 contiguous amino acids, at least 50 contiguous amino acids, at least 100 contiguous amino acids, at least 125 contiguous amino acids, at least 150 contiguous amino acids, at least 200 contiguous amino acids, at least 250 contiguous amino acids, at least 300 contiguous amino acids at least 350 contiguous amino acids, at least 400 contiguous amino acids, at least 450 contiguous amino acids, or at least 500 contiguous amino acids, having a sequence at least 80% identical, at least 85% identical, at least 90% identical, at least 95% identical, at least 97% identical, or at least 99% identical, to at least 25 contiguous amino acids, at least 50 contiguous amino acids, at least 100 contiguous amino acids, at least 125 contiguous amino acids, at least 150 contiguous amino acids, at least 200 contiguous amino acids, at least 250 contiguous amino acids, at least 300 contiguous amino acids at least 350 contiguous amino acids, at least 400 contiguous amino acids, at least 450 contiguous amino acids, or at least 500 contiguous amino acids, from a protein encoded by SEQ ID NO:3. In one embodiment, the nucleic acid molecule comprises a nucleic acid sequence encoding at least 25 contiguous amino acids, at least 50 contiguous amino acids, at least 100 contiguous amino acids, at least 125 contiguous amino acids, at least 150 contiguous amino acids, at least 200 contiguous amino acids, at least 250 contiguous amino acids, at least 300 contiguous amino acids at least 350 contiguous amino acids, at least 400 contiguous amino acids, at least 450 contiguous amino acids, or at least 500 contiguous amino acids, having a sequence at least 80% identical, at least 85% identical, at least 90% identical, at least 95% identical, at least 97% identical, or at least 99% identical, to at least 25 contiguous amino acids, at least 50 contiguous amino acids, at least 100 contiguous amino acids, at least 125 contiguous amino acids, at least 150 contiguous amino acids, at least 200 contiguous amino acids, at least 250 contiguous amino acids, at least 300 contiguous amino acids at least 350 contiguous amino acids, at least 400 contiguous amino acids, at least 450 contiguous amino acids, or at least 500 contiguous amino acids, from SEQ ID NO:4.

As has been described, polypeptides encoded by nucleic acid molecules of the invention can comprise modified proteins. Such modifications can include replacement, deletion, or insertion of individual amino acids, as well as entire regions or domains with corresponding regions or domains from other proteins. Thus, in one embodiment, the polyprotein comprises a Zika virus envelope protein of the invention that has been modified relative to a wild-type Zika virus envelope protein. In one embodiment, a nucleic acid molecule of the invention encodes a polyprotein comprising a modified Zika virus envelope protein. In one embodiment, modification of a Zika virus envelope protein of the invention comprises replacing the stem region, the transmembrane region, or both (the stem/transmembrane region) with the corresponding region from the envelope protein of another flavivirus. In one embodiment, modification of a Zika virus envelope protein of the invention comprises replacing a region comprising SEQ ID NO:6, SEQ ID NO:10 or SEQ ID NO:14 with the corresponding region from the envelope protein of a flavivirus selected from the group consisting of Dengue virus, Japanese Encephalitis Virus, Murray Valley Encephalitis Virus, St. Louis Encephalitis Virus, West Nile Virus, and Yellow Fever Virus. In one embodiment, modification of a Zika virus envelope protein of the invention comprises replacing a region encoded by SEQ ID NO:5, SEQ ID NO:9 or SEQ ID NO:13 with the corresponding region from the envelope protein of a flavivirus selected from the group consisting of Dengue virus, Japanese Encephalitis Virus, Murray Valley Encephalitis Virus, St. Louis Encephalitis Virus, West Nile Virus, and Yellow Fever Virus. In one embodiment, modification of a Zika virus envelope protein of the invention comprises replacing a region comprising SEQ ID NO:6, SEQ ID NO:10 or SEQ ID NO:14 with the corresponding region from Japanese Encephalitis Virus. In one embodiment, modification of a Zika virus envelope protein of the invention comprises replacing a region encoded by SEQ ID NO:5, SEQ ID NO:9 or SEQ ID NO:13 with the corresponding region from Japanese Encephalitis Virus.

In one embodiment, modification of the Zika virus envelop protein comprises replacing the region of the envelope protein corresponding to SEQ ID NO:6 (stem region) with an amino acid sequence at least 85% identical, at least 90% identical, at least 95% identical, at least 97%, identical or at least 99% identical to SEQ ID NO:8. In one embodiment, modification of the Zika virus envelop protein comprises replacing the region of the envelope protein corresponding to SEQ ID NO:6 (stem region) with an amino acid sequence comprising SEQ ID NO:8. In one embodiment, modification of the Zika virus envelop protein comprises replacing the region of the envelope protein corresponding to SEQ ID NO:6 (stem region) with an amino acid sequence consisting of SEQ ID NO:8.

In one embodiment, modification of the Zika virus envelop protein comprises replacing the region of the envelope protein corresponding to SEQ ID NO:10 (transmembrane region) with an amino acid sequence at least 85% identical, at least 90% identical, at least 95% identical, at least 97%, identical or at least 99% identical to SEQ ID NO:12. In one embodiment, modification of the Zika virus envelop protein comprises replacing the region of the envelope protein corresponding to SEQ ID NO:10 (transmembrane region) with an amino acid sequence comprising SEQ ID NO:12. In one embodiment, modification of the Zika virus envelop protein comprises replacing the region of the envelope protein corresponding to SEQ ID NO:10 (transmembrane region) with an amino acid sequence consisting of SEQ ID NO:12.

In one embodiment, modification of the Zika virus envelop protein comprises replacing the region of the envelope protein corresponding to SEQ ID NO:14 (stem/transmembrane region) with an amino acid sequence at least 85% identical, at least 90% identical, at least 95% identical, at least 97%, identical or at least 99% identical to SEQ ID NO:16. In one embodiment, modification of the Zika virus envelop protein comprises replacing the region of the envelope protein corresponding to SEQ ID NO:14 (stem/transmembrane region) with an amino acid sequence comprising SEQ ID NO:16. In one embodiment, modification of the Zika virus envelop protein comprises replacing the region of the envelope protein corresponding to SEQ ID NO:14 (stem/transmembrane region) with an amino acid sequence consisting of SEQ ID NO:16.

In one embodiment, modification of a Zika virus envelope protein of the invention comprises replacing a region encoded by SEQ ID NO:5, SEQ ID NO:9 or SEQ ID NO:13 with the corresponding region from the envelope protein of a flavivirus selected from the group consisting of Dengue virus, Japanese Encephalitis Virus, Murray Valley Encephalitis Virus, St. Louis Encephalitis Virus, West Nile Virus, and Yellow Fever Virus. In one embodiment, modification of a Zika virus envelope protein of the invention comprises replacing a region comprising SEQ ID NO:6, SEQ ID NO:10 or SEQ ID NO:14 with the corresponding region from Japanese Encephalitis Virus. In one embodiment, modification of a Zika virus envelope protein of the invention comprises replacing a region encoded by SEQ ID NO:5, SEQ ID NO:9 or SEQ ID NO:13 with the corresponding region from Japanese Encephalitis Virus.

In one embodiment, the polyprotein comprises a modified Zika virus envelope protein in which the stem region, the transmembrane region, or both (the stem/transmembrane region), has been replaced with the corresponding region from the envelope protein of another flavivirus. In one embodiment, the polyprotein comprises a modified Zika virus envelope protein in which the stem region, the transmembrane region, or both (the stem/transmembrane region), has been replaced with the corresponding region from a flavivirus selected from the group consisting of Dengue virus, Japanese Encephalitis Virus, Murray Valley Encephalitis Virus, St. Louis Encephalitis Virus, West Nile Virus, and Yellow Fever Virus. In one embodiment, the polyprotein comprises a modified Zika virus envelope protein in which the stem region, the transmembrane region, or both (the stem/transmembrane region) has been replaced with the corresponding region from Japanese Encephalitis Virus.

In one embodiment, the polyprotein comprises a modified Zika virus envelope protein in which a region corresponding to SEQ ID NO:6, SEQ ID NO:10 or SEQ ID NO:14, has been replaced with a corresponding region from the envelope protein of a flavivirus selected from the group consisting of Dengue virus, Japanese Encephalitis Virus, Murray Valley Encephalitis Virus, St. Louis Encephalitis Virus, West Nile Virus, and Yellow Fever Virus. In one embodiment, the polyprotein comprises a modified Zika virus envelope protein in which a region corresponding to SEQ ID NO:6, SEQ ID NO:10 or SEQ ID NO:14, has been replaced with a corresponding region from the envelope protein of Japanese Encephalitis Virus.

In one embodiment, the polyprotein comprises a modified Zika virus envelope protein in which a region of the envelope protein comprising SEQ ID NO:6, SEQ ID NO:10 or SEQ ID NO:14, has been replaced with a corresponding region from the envelope protein of a flavivirus selected from the group consisting of Dengue virus, Japanese Encephalitis Virus, Murray Valley Encephalitis Virus, St. Louis Encephalitis Virus, West Nile Virus, and Yellow Fever Virus. In one embodiment, the polyprotein comprises a modified Zika virus envelope protein in which a region of the envelope protein comprising SEQ ID NO:6, SEQ ID NO:10 or SEQ ID NO:14, has been replaced with a corresponding region from the envelope protein of Japanese Encephalitis Virus.

In one embodiment, the polyprotein comprises a modified Zika virus envelope protein in which the stem region has been replaced with the corresponding region from Japanese Encephalitis Virus envelope protein. In one embodiment, the polyprotein comprises a modified Zika virus envelope protein in which the region corresponding to SEQ ID NO:6 has been replaced with an amino acid sequence at least 85% identical, at least 90% identical, at least 95% identical, at least 97% identical, or at least 99% identical, to SEQ ID NO:8. In one embodiment, the polyprotein comprises a modified Zika virus envelope protein in which the region of the protein comprising SEQ ID NO:6 has been replaced with an amino acid sequence at least 85% identical, at least 90% identical, at least 95% identical, at least 97% identical, or at least 99% identical, to SEQ ID NO:8. In one embodiment, the polyprotein comprises a modified Zika virus envelope protein in which the region corresponding to SEQ ID NO:6 has been replaced with SEQ ID NO:8. In one embodiment, the polyprotein comprises a modified Zika virus envelope protein in which the region comprising SEQ ID NO:6 has been replaced with SEQ ID NO:8.

In one embodiment, the polyprotein comprises a modified Zika virus envelope protein in which the transmembrane region has been replaced with the corresponding region from Japanese Encephalitis Virus envelope protein. In one embodiment, the polyprotein comprises a modified Zika virus envelope protein in which the region corresponding to SEQ ID NO:10 has been replaced with an amino acid sequence at least 85% identical, at least 90% identical, at least 95% identical, at least 97% identical, or at least 99% identical, to SEQ ID NO:12. In one embodiment, the polyprotein comprises a modified Zika virus envelope protein in which the region of the protein comprising SEQ ID NO:10 has been replaced with an amino acid sequence at least 85% identical, at least 90% identical, at least 95% identical, at least 97% identical, or at least 99% identical, to SEQ ID NO:12. In one embodiment, the polyprotein comprises a modified Zika virus envelope protein in which the region corresponding to SEQ ID NO:10 has been replaced with SEQ ID NO:12. In one embodiment, the polyprotein comprises a modified Zika virus envelope protein in which the region comprising SEQ ID NO:10 has been replaced with SEQ ID NO:12.

In one embodiment, the polyprotein comprises a modified Zika virus envelope protein in which the stem/transmembrane region has been replaced with the corresponding region from Japanese Encephalitis Virus envelope protein. In one embodiment, the polyprotein comprises a modified Zika virus envelope protein in which the region corresponding to SEQ ID NO:14 has been replaced with an amino acid sequence at least 85% identical, at least 90% identical, at least 95% identical, at least 97% identical, or at least 99% identical, to SEQ ID NO:16. In one embodiment, the polyprotein comprises a modified Zika virus envelope protein in which the region of the protein comprising SEQ ID NO:14 has been replaced with an amino acid sequence at least 85% identical, at least 90% identical, at least 95% identical, at least 97% identical, or at least 99% identical, to SEQ ID NO:16. In one embodiment, the polyprotein comprises a modified Zika virus envelope protein in which the region corresponding to SEQ ID NO:14 has been replaced with SEQ ID NO:16. In one embodiment, the polyprotein comprises a modified Zika virus envelope protein in which the region comprising SEQ ID NO:14 has been replaced with SEQ ID NO:16.

In one embodiment, the nucleic acid molecule comprises a nucleic acid sequence encoding a modified Zika virus envelope protein in which the stem region, the transmembrane region, or both (the stem/transmembrane region) has been replaced with the corresponding region from the envelope protein of another flavivirus. In one embodiment, the nucleic acid molecule comprises a nucleic acid sequence encoding a modified Zika virus envelope protein in which the stem region, the transmembrane region, or both (the stem/transmembrane region) has been replaced with the corresponding region from a flavivirus selected from the group consisting of Dengue virus, Japanese Encephalitis Virus, Murray Valley Encephalitis Virus, St. Louis Encephalitis Virus, West Nile Virus, and Yellow Fever Virus. In one embodiment, the nucleic acid molecule comprises a nucleic acid sequence encoding a modified Zika virus envelope protein in which the stem region, the transmembrane region, or both (the stem/transmembrane region) has been replaced with the corresponding region from Japanese Encephalitis Virus.

In one embodiment, the nucleic acid molecule comprises a nucleic acid sequence encoding a modified Zika virus envelope protein in which a region corresponding to SEQ ID NO:6, SEQ ID NO:10 or SEQ ID NO:14, has been replaced with a corresponding region from the envelope protein of a flavivirus selected from the group consisting of Dengue virus, Japanese Encephalitis Virus, Murray Valley Encephalitis Virus, St. Louis Encephalitis Virus, West Nile Virus, and Yellow Fever Virus. In one embodiment, the nucleic acid molecule comprises a nucleic acid sequence encoding a modified Zika virus envelope protein in which a region corresponding to SEQ ID NO:6, SEQ ID NO:10 or SEQ ID NO:14, has been replaced with a corresponding region from the envelope protein of Japanese Encephalitis Virus.

In one embodiment, the nucleic acid molecule comprises a nucleic acid sequence encoding a modified Zika virus envelope protein in which a region of the envelope protein comprising SEQ ID NO:6, SEQ ID NO:10 or SEQ ID NO:14, has been replaced with a corresponding region from the envelope protein of a flavivirus selected from the group consisting of Dengue virus, Japanese Encephalitis Virus, Murray Valley Encephalitis Virus, St. Louis Encephalitis Virus, West Nile Virus, and Yellow Fever Virus. In one embodiment, the nucleic acid molecule comprises a nucleic acid sequence encoding a modified Zika virus envelope protein in which a region of the envelope protein comprising SEQ ID NO:6, SEQ ID NO:10 or SEQ ID NO:14, has been replaced with a corresponding region from the envelope protein of Japanese Encephalitis Virus.

In one embodiment, the nucleic acid molecule comprises a nucleic acid sequence encoding a modified Zika virus envelope protein in which the stem region has been replaced with the corresponding region from Japanese Encephalitis Virus envelope protein. In one embodiment, the nucleic acid molecule comprises a nucleic acid sequence encoding a modified Zika virus envelope protein in which the region corresponding to SEQ ID NO:6 has been replaced with an amino acid sequence at least 85% identical, at least 90% identical, at least 95% identical, at least 97% identical, or at least 99% identical, to SEQ ID NO:8. In one embodiment, the nucleic acid molecule comprises a nucleic acid sequence encoding a modified Zika virus envelope protein in which the region of the protein comprising SEQ ID NO:6 has been replaced with an amino acid sequence at least 85% identical, at least 90% identical, at least 95% identical, at least 97% identical, or at least 99% identical, to SEQ ID NO:8. In one embodiment, the nucleic acid molecule comprises a nucleic acid sequence encoding a modified Zika virus envelope protein in which the region corresponding to SEQ ID NO:6 has been replaced with SEQ ID NO:8. In one embodiment, the nucleic acid molecule comprises a nucleic acid sequence encoding a modified Zika virus envelope protein in which the region comprising SEQ ID NO:6 has been replaced with SEQ ID NO:8.

In one embodiment, the nucleic acid molecule comprises a nucleic acid sequence encoding a modified Zika virus envelope protein in which the transmembrane region has been replaced with the corresponding region from Japanese Encephalitis Virus envelope protein. In one embodiment, the nucleic acid molecule comprises a nucleic acid sequence encoding a modified Zika virus envelope protein in which the region corresponding to SEQ ID NO:10 has been replaced with an amino acid sequence at least 85% identical, at least 90% identical, at least 95% identical, at least 97% identical, or at least 99% identical, to SEQ ID NO:12. In one embodiment, the nucleic acid molecule comprises a nucleic acid sequence encoding a modified Zika virus envelope protein in which the region of the protein comprising SEQ ID NO:10 has been replaced with an amino acid sequence at least 85% identical, at least 90% identical, at least 95% identical, at least 97% identical, or at least 99% identical, to SEQ ID NO:12. In one embodiment, the nucleic acid molecule comprises a nucleic acid sequence encoding a modified Zika virus envelope protein in which the region corresponding to SEQ ID NO:10 has been replaced with SEQ ID NO:12. In one embodiment, the nucleic acid molecule comprises a nucleic acid sequence encoding a modified Zika virus envelope protein in which the region comprising SEQ ID NO:10 has been replaced with SEQ ID NO:12.

In one embodiment, the nucleic acid molecule comprises a nucleic acid sequence encoding a modified Zika virus envelope protein in which the stem/transmembrane region has been replaced with the corresponding region from Japanese Encephalitis Virus envelope protein. In one embodiment, the nucleic acid molecule comprises a nucleic acid sequence encoding a modified Zika virus envelope protein in which the region corresponding to SEQ ID NO:14 has been replaced with an amino acid sequence at least 85% identical, at least 90% identical, at least 95% identical, at least 97% identical, or at least 99% identical, to SEQ ID NO:16. In one embodiment, the nucleic acid molecule comprises a nucleic acid sequence encoding a modified Zika virus envelope protein in which the region of the protein comprising SEQ ID NO:14 has been replaced with an amino acid sequence at least 85% identical, at least 90% identical, at least 95% identical, at least 97% identical, or at least 99% identical, to SEQ ID NO:16. In one embodiment, the nucleic acid molecule comprises a nucleic acid sequence encoding a modified Zika virus envelope protein in which the region corresponding to SEQ ID NO:14 has been replaced with SEQ ID NO:16. In one embodiment, the nucleic acid molecule comprises a nucleic acid sequence encoding a modified Zika virus envelope protein in which the region comprising SEQ ID NO:14 has been replaced with SEQ ID NO:16.

As noted above, nucleic acid molecules of the invention encode proteins capable of forming virus-like particles (VLPs) that elicit an immune response to Zika virus. The inventors have found that certain mutations in Zika virus structural proteins can alter the characteristics (e.g., yield, stability, immunogenicity, etc.) of VLPs comprising such proteins. Such mutations can be at locations that increase interactions between amino acids within or between proteins (e.g., hydrophobic interactions, ionic interactions, etc.). Such mutations can also effect glycosylation of the viral structural proteins. Examples of such mutations can be found in the modified proteins listed in Table 1.

One embodiment of the invention is a nucleic acid molecule comprising a nucleic acid sequence that encodes a protein comprising an amino acid sequence at least 90% identical, at least 95% identical, at least 97% identical, or at least 99% identical, to the prM protein portion of a modified polyprotein listed in Table 1. One embodiment of the invention is a nucleic acid molecule comprising a nucleic acid sequence encoding the prM protein portion of a modified polyprotein listed in Table 1. One embodiment of the invention is a nucleic acid molecule comprising a nucleic acid sequence that encodes a protein comprising an amino acid sequence at least 90% identical, at least 95% identical, at least 97% identical, or at least 99% identical, to the prM protein portion of a modified polyprotein comprising a sequence selected from the group consisting of SEQ ID NO:29-SEQ ID NO:239. One embodiment of the invention is a nucleic acid molecule comprising a nucleic acid sequence encoding the prM protein portion of a modified polyprotein comprising a sequence selected from the group consisting of SEQ ID NO:29-SEQ ID NO:239.

One embodiment of the invention is a nucleic acid molecule comprising a nucleic acid sequence that encodes a protein comprising an amino acid sequence at least 90% identical, at least 95% identical, at least 97% identical, or at least 99% identical, to the envelope protein portion of a modified polyprotein listed in Table 1. One embodiment of the invention is a nucleic acid molecule comprising a nucleic acid sequence encoding the envelope protein portion of a modified polyprotein listed in Table 1. One embodiment of the invention is a nucleic acid molecule comprising a nucleic acid sequence that encodes a protein comprising an amino acid sequence at least 90% identical, at least 95% identical, at least 97% identical, or at least 99% identical, to the envelope protein portion of a modified polyprotein comprising a sequence selected from the group consisting of SEQ ID NO:29-SEQ ID NO:239. One embodiment of the invention is a nucleic acid molecule comprising a nucleic acid sequence encoding the envelope protein portion of a modified polyprotein comprising a sequence selected from the group consisting of SEQ ID NO:29-SEQ ID NO:239.

One embodiment of the invention is a nucleic acid molecule comprising a nucleic acid sequence that encodes a protein comprising an amino acid sequence at least 90% identical, at least 95% identical, at least 97% identical, or at least 99% identical to a modified polyprotein listed in Table 1. One embodiment of the invention is a nucleic acid molecule comprising a nucleic acid sequence encoding a modified polyprotein listed in Table 1. One embodiment of the invention is a nucleic acid molecule comprising a nucleic acid sequence that encodes a protein comprising an amino acid sequence at least 90% identical, at least 95% identical, at least 97% identical, or at least 99% identical, to a modified polyprotein comprising a sequence selected from the group consisting of SEQ ID NO:29-SEQ ID NO:239. One embodiment of the invention is a nucleic acid molecule comprising a nucleic acid sequence encoding a modified polyprotein comprising a sequence selected from the group consisting of SEQ ID NO:29-SEQ ID NO:239.

One embodiment of the invention is a nucleic acid molecule comprising a nucleic acid sequence at least 90% identical, at least 95% identical, at least 97% identical, or at least 99% identical, to a sequence encoding the prM protein portion of a polyprotein listed in Table 1. One embodiment of the invention is a nucleic acid molecule comprising a nucleic acid sequence at least 90% identical, at least 95% identical, at least 97% identical, or at least 99% identical, to a sequence encoding the envelope protein portion of a polyprotein listed in Table 1. One embodiment of the invention is a nucleic acid molecule comprising a nucleic acid sequence at least 90% identical, at least 95% identical, at least 97% identical, or at least 99% identical, to a sequence encoding an amino acid sequence selected from the group consisting of SEQ ID NO:29-SEQ ID NO:239.

In one embodiment, the nucleic acid molecule comprises a nucleic acid sequence at least 90% identical, at least 95% identical, at least 97% identical, or at least 99% identical, to a nucleic acid sequence selected from the group consisting of SEQ ID NO:240-SEQ ID NO:450. In one embodiment, the nucleic acid molecule comprises a nucleic acid sequence selected from the group consisting of SEQ ID NO:240-SEQ ID NO:450.

Expression of the proteins encoded by nucleic acid molecules of the invention results in formation of virus-like particles capable of inducing an immune response in an individual. Thus, in certain embodiments of the invention the nucleic acid sequences encoding the signal sequence joined to the polyprotein, are functionally linked to a control element. Nucleic acid molecules of the invention comprising such control elements can be referred to as expression vectors. As used herein, the term functionally linked means that interaction cellular and/or viral proteins with control elements, affects transcription of the linked nucleotide sequences. As used herein, control elements are nucleotide sequences in the nucleotide molecule at which cellular and or viral proteins bind, such binding affecting transcription of linked nucleotide sequences. Examples of control elements include, but are not limited to, promoter sequences, enhancer sequences, repressor sequences and terminator sequences. Thus, in one embodiment, nucleic acid sequences encoding the signal sequence joined to the polyprotein, are functionally linked to a promoter sequence. A preferred promoter sequence is any promoter sequence that functions (i.e., directs transcription of linked nucleotide sequences) in a mammalian cell. Such promoters can be of mammalian, viral or bacterial origin. Examples of useful promoter sequences include, but are not limited to, mammalian elongation factor-1 (EF-1) promoter and cytomegalovirus (CMV) promoter. Promoters useful for constructing nucleic acid molecules of the invention are known to those skilled in the art. Exemplary expression vectors include polynucleotide molecules, preferably DNA molecules, that are derived, for example, from a plasmid, bacteriophage, yeast or virus (e.g., adenovirus, adeno-associated virus, lentivirus, retrovirus, etc.), into which a polynucleotide can be inserted or cloned. Suitable expression vectors are known to those skilled in the art. Examples of vectors useful for practicing the present invention are listed in Table 1.

Proteins

Nucleic acid molecules of the invention are useful for producing proteins of the invention. Thus, one embodiment of the invention is a protein encoded by a nucleic acid molecule of the invention. One embodiment of the invention is a fusion protein comprising the signal sequence of a Japanese Encephalitis Virus prM protein, joined to a Zika virus membrane protein. In one embodiment, the fusion protein comprises a modified Zika virus prM protein, wherein the Zika prM protein has been modified by replacing the signal sequence with the signal sequence from a Japanese Encephalitis Virus prM protein signal sequence. Such a construct is exemplified in FIG. 1A. In one embodiment, the fusion protein comprises a modified Zika virus prM protein, wherein the region corresponding to SEQ ID NO:22 has been replaced with the signal sequence from a Japanese Encephalitis Virus prM protein signal sequence. In one embodiment, the fusion protein comprises a modified Zika virus prM protein, wherein the region comprising SEQ ID NO:22 has been replaced with the signal sequence from a Japanese Encephalitis Virus prM protein signal sequence. In one embodiment, the fusion protein comprises a modified Zika virus prM protein, wherein the region corresponding to SEQ ID NO:22 has been replaced with an amino acid sequence at least 90% identical, at least 95% identical, at least 97% identical, or at least 99% identical, to SEQ ID NO:18. In one embodiment, the fusion protein comprises a modified Zika virus prM protein, wherein the region corresponding to SEQ ID NO:22 has been replaced with SEQ ID NO:18. In one embodiment, the fusion protein comprises a modified Zika virus prM protein, wherein the region comprising SEQ ID NO:22 has been replaced with an amino acid sequence at least 90% identical, at least 95% identical, at least 97% identical, or at least 99% identical, to SEQ ID NO:18. In one embodiment, the fusion protein comprises a modified Zika virus prM protein, wherein the region comprising SEQ ID NO:22 has been replaced with SEQ ID NO:18. In one embodiment, the fusion protein comprises an amino acid sequence at least 85% identical, at least 90% identical, at least 95% identical, at least 97% identical, or at least 99% identical, to the sequence of a modified protein Listed in Table 3.

TABLE 3

Exemplary amino acid and nucleic acid sequences of modified polyproteins.

| SEQ ID NO. | Molecule | Comments |
|---|---|---|
| | | Proteins |
| 29 | Protein | VRC4974-CMVR-(JEV-SA)Zika-PF2013-prM-E |
| 30 | Protein | VRC4975-CMVR-(mIg-SA)Zika-PF2013-prM-E |
| 31 | Protein | VRC4976-CMVR-Zika-PF2013-prM-E |
| 32 | Protein | VRC4977-CMVR-(JEV-SA)Zika-PF2013-E |
| 33 | Protein | VRC4978-CMVR-(mIg-SA)Zika-PF2013-E |
| 34 | Protein | VRC4979-CMVR-Zika-PF2013-E |
| 35 | Protein | VRC4980-CMVR-Zika-PF2013-E-DTM-Avi3chis |
| 36 | Protein | VRC4983-CMVR-Zika-PF2013-E-DTM |
| 37 | Protein | VRC4984-CMVR-Zika-PF2013-E-DTM-Avi3chis |
| 38 | Protein | VRC5102-CMVR-(JEV-SA)Zika-PF2013-E-DTM |
| 39 | Protein | VRC5103-CMVR-(mIg-SA)Zika-PF2013-E-DTM |
| 40 | Protein | VRC5104-CMVR-(JEV-SA)Zika-PF2013-E-DFP1 |
| 41 | Protein | VRC5105-CMVR-(JEV-SA)Zika-PF2013-E-DFP2 |
| 42 | Protein | VRC5106-CMVR-(JEV-SA)Zika-PF2013-E-DFP1-DTM |
| 43 | Protein | VRC5107-CMVR-(JEV-SA)Zika-PF2013-E-DFP2-DTM |
| 44 | Protein | VRC5108-CMVR-(JEV-SA)Zika-PF2013-E-DFP1-DTM-Avi3chis |
| 45 | Protein | VRC5109-CMVR-(JEV-SA)Zika-PF2013-E-DFP2-DTM-Avi3chis |
| 46 | Protein | VRC5110-CMVR-(JEV-SA)Zika-PF2013-prM-CS1-E |
| 47 | Protein | VRC5111-CMVR-(JEV-SA)Zika-PF2013-prM-CS2-E |
| 48 | Protein | VRC5112-CMVR-(JEV-SA)Zika-PF2013-prM-E-DFP1 |
| 49 | Protein | VRC5113-CMVR-(JEV-SA)Zika-PF2013-prM-E-DFP2 |
| 50 | Protein | VRC5114-CMVR-(JEV-SA)Zika-PF2013-prM-CS1-E-DFP1 |
| 51 | Protein | VRC5115-CMVR-(JEV-SA)Zika-PF2013-prM-CS2-E-DFP1 |
| 52 | Protein | VRC5116-CMVR-(JEV-SA)Zika-PF2013-prM-CS1-E-DFP2 |
| 53 | Protein | VRC5117-CMVR-(JEV-SA)Zika-PF2013-prM-CS2-E-DFP2 |
| 54 | Protein | VRC5118-CMVR-(JEV-SA)Zika-PF2013-prM-CS1-E-DFP1-DTM |
| 55 | Protein | VRC5119-CMVR-(JEV-SA)Zika-PF2013-prM-CS2-E-DFP1-DTM |
| 56 | Protein | VRC5120-CMVR-(JEV-SA)Zika-PF2013-prM-CS1-E-DFP2-DTM |
| 57 | Protein | VRC5121-CMVR-(JEV-SA)Zika-PF2013-prM-CS2-E-DFP2-DTM |
| 58 | Protein | VRC5122-JEVss-prM-E_WNV_Stem/TM |
| 59 | Protein | VRC5123-pCMV/R-JEVss-ZIKV.PF2013.prME80-JEV.SA14.E20 |
| 60 | Protein | VRC5124-JEVss-E_WNV_Stem/TM |
| 61 | Protein | VRC5125-JEVss-E_JEV_Stem/TM |

TABLE 3-continued

Exemplary amino acid and nucleic acid sequences of modified polyproteins.

| SEQ ID NO. | Molecule | Comments |
| --- | --- | --- |
| 62 | Protein | VRC5126-JEVss-prM-E_DENV4_Stem/TM |
| 63 | Protein | VRC5127-JEVss-E_DENV4_Stem/TM |
| 64 | Protein | VRC5131-DENV1 16007 JEVss-prM-E80-V5His |
| 65 | Protein | VRC5132-DENV2_New_Guinea_C_JEVss-prM-E80-V5His |
| 66 | Protein | VRC5133-WNV_NY99_JEVss-prM-E80-V5His |
| 67 | Protein | VRC5134-Zika_H_PF_2013_JEVss-prM-E80-V5His |
| 68 | Protein | VRC5135-DENV1 16007 JEVss-prM-E80W101R-V5His |
| 69 | Protein | VRC5136-DENV2_New_Guinea_C_JEVss-prM-E80W101R-V5His |
| 70 | Protein | VRC5137-WNV_NY99_JEVss-prM-E80W101R-V5His |
| 71 | Protein | VRC5138-Zika_H_PF_2013_JEVss-prM-E80W101R-V5His |
| 72 | Protein | VRC5220-CMVR-(JEV-ss)Zika-PF2013-(+3AA)prM-E |
| 73 | Protein | VRC5221-pcDNA3.1-ZIKV_ArB7701_CprME |
| 74 | Protein | VRC5222-pcDNA3.1-ZIKV_ArB7701_prME |
| 75 | Protein | VRC5223-pcDNA3.1-ZIKV_ArD7117_CprME |
| 76 | Protein | VRC5224-pcDNA3.1-ZIKV_ArD7117_prME |
| 77 | Protein | VRC5225-pcDNA3.1-ZIKV_MR766-CHO_CprME |
| 78 | Protein | VRC5226-pcDNA3.1-ZIKV_MR766-CHO_prME |
| 79 | Protein | VRC5227-pcDNA3.1-ZIKV_MR766+CHO_CprME |
| 80 | Protein | VRC5228-pcDNA3.1-ZIKV_MR766+CHO_prME |
| 81 | Protein | VRC5229-pcDNA3.1-ZIKV_PHL2012_CprME |
| 82 | Protein | VRC5230-pcDNA3.1-ZIKV_PHL2012_prME |
| 83 | Protein | VRC5231-pcDNA3.1-ZIKV_THA2014_CprME |
| 84 | Protein | VRC5232-pcDNA3.1-ZIKV_THA2014_prME |
| 85 | Protein | VRC5233-pcDNA3.1-Zika_HPF2013 CprME + CHO mut |
| 86 | Protein | VRC5234-pcDNA3.1-Zika_HPF2013 CprME + WNV loop + CHO mut |
| 87 | Protein | VRC5235-pcDNA3.1-Zika_HPF2013 CprME + DV1 loop + CHO mut |
| 88 | Protein | VRC5236-pcDNA3.1-Zika_HPF2013 CprME + DV2 loop + CHO mut |
| 89 | Protein | VRC5237-pcDNA3.1-WNV NY99 CprME + Zika_HPF2013 loop + CHO mut |
| 90 | Protein | VRC5238-pcDNA3.1-DV1 16007 CprME + Zika_HPF2013 loop + CHO mut |
| 91 | Protein | VRC5239-pcDNA3.1-DV2 16681 CprME + Zika_HPF2013 loop + CHO mut |
| 92 | Protein | VRC5240-pcDNA3.1-Zika_HPF2013 CprME + WNV loop |
| 93 | Protein | VRC5241-pcDNA3.1-Zika_HPF2013 CprME + DV1 loop |
| 94 | Protein | VRC5242-pcDNA3.1-Zika_HPF2013 CprME + DV2 loop |
| 95 | Protein | VRC5243-pcDNA3.1-WNV NY99 CprME + Zika_HPF2013 loop |

TABLE 3-continued

Exemplary amino acid and nucleic acid sequences of modified polyproteins.

| SEQ ID NO. | Molecule | Comments |
|---|---|---|
| 96 | Protein | VRC5244-pcDNA3.1-DV1 16007 CprME + Zika_HPF2013 loop |
| 97 | Protein | VRC5245-pcDNA3.1-DV2 16681 CprME + Zika_HPF2013 loop |
| 98 | Protein | VRC5271-CMV/R-ZIKV_ArB7701_CprME |
| 99 | Protein | VRC5272-CMV/R-ZIKV_ArB7701_prME |
| 100 | Protein | VRC5273-CMV/R-ZIKV_ArD7117_CprME |
| 101 | Protein | VRC5274-CMV/R-ZIKV_ArD7117_prME |
| 102 | Protein | VRC5275-CMV/R-ZIKV_MR766-CHO_CprME |
| 103 | Protein | VRC5276-CMV/R-ZIKV_MR766-CHO_prME |
| 104 | Protein | VRC5277-CMV/R-ZIKV_MR766+CHO_CprME |
| 105 | Protein | VRC5278-CMV/R-ZIKV_MR766+CHO_prME |
| 106 | Protein | VRC5279-CMV/R-ZIKV_PHL2012_CprME |
| 107 | Protein | VRC5280-CMV/R-ZIKV_PHL2012_prME |
| 108 | Protein | VRC5281-CMV/R-ZIKV_THA2014_CprME |
| 109 | Protein | VRC5282-CMV/R-ZIKV_THA2014_prME |
| 110 | Protein | VRC5283-CMVR-(JEV-SA)Zika-PF2013-prM-w12Gat vector |
| 111 | Protein | VRC5284-CMVR-(JEV-SA)Zika-PF2013-EA275V-DTM |
| 112 | Protein | VRC5285-JEVss-prM-EA275_V_JEV_Stem/TM |
| 113 | Protein | VRC5286-CMVR-(JEV-ss)Zika-PF2013-(+3AA)prM-EA275V |
| 114 | Protein | VRC5288-pCMV/R-JEVss-AEV-ZIKV.PF2013.prME80-JEV.SA14.E20 |
| 115 | Protein | VRC5289-pCMV/R-JEVss-ZIKV.PF2013.prME80.A275V-JEV.SA14.E20 |
| 116 | Protein | VRC5290-pCMV/R-JEVss-AEV-ZIKV.PF2013.prME80.A275V-JEV.SA14.E20 |
| 117 | Protein | VRC5291-pCMV/R-KZ.gc-JEVss-AEV-ZIKV.PF2013.prME80-JEV.SA14.E20 |
| 118 | Protein | VRC5292-pCMV/R-JEVss-ZIKV.PF2013.prME80-ZIKV.MR766.E20 |
| 119 | Protein | VRC5293-pCMV/R-JEVss-ZIKV.PF2013.prM50E80-ZIKV.MR766.M50E20 |
| 120 | Protein | VRC5294-pCMV/R-JEVss-ZIKV.PF2013.prM30E80-ZIKV.MR766.M70E20 |
| 121 | Protein | VRC5295-pCMV/R-hCD5ss-AEV-ZIKV.PF2013.prME80-JEV.SA14.E20 |
| 122 | Protein | VRC5296-pCMV/R-hCD5ss-ZIKV.PF2013.prME |
| 123 | Protein | VRC5296-pCMV/R-hCD5ss-ZIKV.PF2013.prME.A275V |
| 124 | Protein | VRC5299-pCMV/R-hCD5ss-ZIKV.PF2013.prME |
| 125 | Protein | VRC5450_KZ-gc-JEVss-AEV-PFwt_VRCZIKA_BR_wt_optimized |
| 126 | Protein | VRC5451_KZ-gc-JEVss-AEV-PF-pr22-pr72_VRCZIKA_BR_1_optimized |

TABLE 3-continued

Exemplary amino acid and nucleic acid sequences of modified polyproteins.

| SEQ ID NO. | Molecule | Comments |
|---|---|---|
| 127 | Protein | VRC5452_KZ-gc-JEVss-AEV-PF-furinA_VRCZIKA_BR_2_optimized |
| 128 | Protein | VRC5453_KZ-gc-JEVss-AEV-PF-furinB_VRCZIKA_BR_3_optimized |
| 129 | Protein | VRC5454_KZ-gc-JEVss-AEV-PF-furinC_VRCZIKA_BR_4_optimized |
| 130 | Protein | VRC5455_KZ-gc-JEVss-AEV-PF-furinD_VRCZIKA_BR_5_optimized |
| 131 | Protein | VRC5456_KZ-gc-JEVss-AEV-PF-furinE_VRCZIKA_BR_6_optimized |
| 132 | Protein | VRC5457_KZ-gc-JEVss-AEV-PF-furinF_VRCZIKA_BR_7_optimized |
| 133 | Protein | VRC5458_KZ-gc-JEVss-AEV-PF-furinG_VRCZIKA_BR_8_optimized |
| 134 | Protein | VRC5459_KZ-gc-JEVss-AEV-PF-furinH_VRCZIKA_BR_9_optimized |
| 135 | Protein | VRC5460_KZ-gc-JEVss-AEV-PF-fusionA_VRCZIKA_BR_10_optimized |
| 136 | Protein | VRC5461_KZ-gc-JEVss-AEV-PF-fusionB_VRCZIKA_BR_11_optimized |
| 137 | Protein | VRC5462_KZ-gc-JEVss-AEV-PF-fusionC_VRCZIKA_BR_12_optimized |
| 138 | Protein | VRC5463_KZ-gc-JEVss-AEV-PF-fusionD_VRCZIKA_BR_13_optimized |
| 139 | Protein | VRC5464_KZ-gc-JEVss-AEV-PF-fusionE_VRCZIKA_BR_14_optimized |
| 140 | Protein | VRC5465_KZ-gc-JEVss-AEV-PF-E275_VRCZIKA_BR_15_optimized |
| 141 | Protein | VRC5466_KZ-gc-JEVss-AEV-PF-linkWNV_VRCZIKA_BR_16_optimized |
| 142 | Protein | VRC5467_KZ-gc-JEVss-AEV-PF-stemWNV_VRCZIKA_BR_17_optimized |
| 143 | Protein | VRC5468_KZ-gc-JEVss-AEV-PF-E20WNV_VRCZIKA_BR_18_optimized |
| 144 | Protein | VRC5469_KZ-gc-JEVss-AEV-PF-E20JEV_VRCZIKA_BR_19_optimized |
| 145 | Protein | VRC5470_KZ-gc-JEVss-AEV-PF-stem + WNV_VRCZIKA_BR_20_optimized |
| 146 | Protein | VRC5471_KZ-gc-JEVss-AEV-PF-stem + JEV_VRCZIKA_BR_21_optimized |
| 147 | Protein | VRC5472_KZ-gc-JEVss-AEV-PF-ptstemWNV_VRCZIKA_BR_22_optimized |
| 148 | Protein | VRC5473_KZ-gc-JEVss-AEV-PF-ptstemJEV_VRCZIKA_BR_23_optimized |
| 149 | Protein | VRC5474_KZ-gc-JEVss-AEV-PF-2Eaas_VRCZIKA_BR_24_optimized |
| 150 | Protein | VRC5475_KZ-gc-JEVss-AEV-PF-glycE64_VRCZIKA_BR_25_optimized |
| 151 | Protein | VRC5476_KZ-gc-JEVss-AEV-PF-glycE68_VRCZIKA_BR_26_optimized |

TABLE 3-continued

Exemplary amino acid and nucleic acid sequences of modified polyproteins.

| SEQ ID NO. | Molecule | Comments |
|---|---|---|
| 152 | Protein | VRC5477_KZ-gc-JEVss-AEV-PF-comb1-4-10-15-16-19-26_VRCZIKA_BR_27_optimized |
| 153 | Protein | VRC5478_KZ-gc-JEVss-AEV-PF-comb1-8-10-15-16-19-26_VRCZIKA_BR_28_optimized |
| 154 | Protein | VRC5479_KZ-gc-JEVss-AEV-PF-comb1-4-13-15-16-19-26_VRCZIKA_BR_29_optimized |
| 155 | Protein | VRC5480_KZ-gc-JEVss-AEV-PF-comb1-4-10-15-16-18-26_VRCZIKA_BR_30_optimized |
| 156 | Protein | VRC5481_KZ-gc-JEVss-AEV-PF-comb1-4-10-14-16-19-26_VRCZIKA_BR_31_optimized |
| 157 | Protein | VRC5482_KZ-gc-JEVss-AEV-PF-comb1-4-10-15-16-22-26_VRCZIKA_BR_32_optimized |
| 158 | Protein | VRC5483_KZ-gc-JEVss-AEV-PF-comb4-10_VRCZIKA_BR_33_optimized |
| 159 | Protein | VRC5484_KZ-gc-JEVss-AEV-PF-comb4-19_VRCZIKA_BR_34_optimized |
| 160 | Protein | VRC5485_KZ-gc-JEVss-AEV-PF-comb4-26_VRCZIKA_BR_35_optimized |
| 161 | Protein | VRC5486_KZ-gc-JEVss-AEV-PF-comb10-16_VRCZIKA_BR_36_optimized |
| 162 | Protein | VRC5487_KZ-gc-JEVss-AEV-PF-comb10-19_VRCZIKA_BR_37_optimized |
| 163 | Protein | VRC5488_KZ-gc-JEVss-AEV-PF-comb19-26_VRCZIKA_BR_38_optimized |
| 164 | Protein | VRC5489_KZ-gc-JEVss-AEV-PF-comb16-19_VRCZIKA_BR_39_optimized |
| 165 | Protein | VRC5490_KZ-gc-JEVss-AEV-PF-comb15-19_VRCZIKA_BR_40_optimized |
| 166 | Protein | VRC5491_KZ-gc-JEVss-AEV-PF-UgandaA_VRCZIKA_BR_41_optimized |
| 167 | Protein | VRC5492_KZ-gc-JEVss-AEV-PF-UgandaB_VRCZIKA_BR_42_optimized |
| 168 | Protein | VRC5493_diffKZ-gc-JEVss-AEV-PF-E20JEV_VRCZIKA_BR_43_optimized |
| 169 | Protein | VRC6101-ZIKV-prME-G106R |
| 170 | Protein | VRC6102-ZIKV-prME-L107D |
| 171 | Protein | VRC6103-ZIKV-prME-G106R, L107D |
| 172 | Protein | VRC6104-ZIKV-prME-T76A, Q77G, W101R |
| 173 | Protein | VRC6105-ZIKV-prME-T76A, Q77G |
| 174 | Protein | VRC6106-ZIKV-prME-T76A, Q77G, G106R, L107D, W101R |
| 175 | Protein | VRC6107-ZIKV-prME-G106R, L107D, W101R |
| 176 | Protein | VRC6108-ZIKV-prME-T76A |
| 177 | Protein | VRC6109-ZIKV-prME-Q77G |
| 178 | Protein | VRC6110-ZIKV-prME-W101R |
| 179 | Protein | VRC6111-ZIKV-prME-K251A |
| 180 | Protein | VRC6112-ZIKV-prME-Q253A |

TABLE 3-continued

Exemplary amino acid and nucleic acid sequences of modified polyproteins.

| SEQ ID NO. | Molecule | Comments |
|---|---|---|
| 181 | Protein | VRC6113-ZIKV-prME-H266A |
| 182 | Protein | VRC6114-ZIKV-prME-E262A |
| 183 | Protein | VRC6115-ZIKV-prME-V255A |
| 184 | Protein | VRC6116-ZIKV-prME-V256A |
| 185 | Protein | VRC6117-ZIKV-prME-V257A |
| 186 | Protein | VRC6118-ZIKV-prME-Q261A |
| 187 | Protein | VRC6119-ZIKV-prME-D296A |
| 188 | Protein | VRC6120-ZIKV-prME-K297A |
| 189 | Protein | VRC6121-ZIKV-prME-L300A |
| 190 | Protein | VRC6122-ZIKV-prME-S304A |
| 191 | Protein | VRC6123-ZIKV-prME-Y305A |
| 192 | Protein | VRC6124-ZIKV-prME-L307A |
| 193 | Protein | VRC6125-ZIKV-prME-R2A |
| 194 | Protein | VRC6126-ZIKV-prME-G5A |
| 195 | Protein | VRC6127-ZIKV-prME-N8A |
| 196 | Protein | VRC6128-ZIKV-prME-S16A |
| 197 | Protein | VRC6129-ZIKV-prME-G28A |
| 198 | Protein | VRC6130-ZIKV-prME-A54G |
| 199 | Protein | VRC6131-ZIKV-prME-D87A |
| 200 | Protein | VRC6132-ZIKV-prME-N134A |
| 201 | Protein | VRC6133-ZIKV-prME-T170A |
| 202 | Protein | VRC6134-ZIKV-prME-E177A |
| 203 | Protein | VRC6135-ZIKV-prME-T160A |
| 204 | Protein | VRC6136-ZIKV-prME-R193A |
| 205 | Protein | VRC6137-ZIKV-prME-P222A |
| 206 | Protein | VRC6138-ZIKV-prME-W225A |
| 207 | Protein | VRC6139-ZIKV-prME-T231A |
| 208 | Protein | VRC6140-ZIKV-prME-K316A |
| 209 | Protein | VRC6141-ZIKV-prME-E320A |
| 210 | Protein | VRC6142-ZIKV-prME-K251R |
| 211 | Protein | VRC6143-ZIKV-prME-Q253E |
| 212 | Protein | VRC6144-ZIKV-prME-E262Q |
| 213 | Protein | VRC6145-ZIKV-prME-V255I |
| 214 | Protein | VRC6146-ZIKV-prME-V256I |
| 215 | Protein | VRC6147-ZIKV-prME-V257I |
| 216 | Protein | VRC6148-ZIKV-prME-Q261E |
| 217 | Protein | VRC6149-ZIKV-prME-D296N |

TABLE 3-continued

Exemplary amino acid and nucleic acid sequences of modified polyproteins.

| SEQ ID NO. | Molecule | Comments |
|---|---|---|
| 218 | Protein | VRC6150-ZIKV-prME-K297R |
| 219 | Protein | VRC6151-ZIKV-prME-L300I |
| 220 | Protein | VRC6152-ZIKV-prME-S304T |
| 221 | Protein | VRC6153-ZIKV-prME-Y305F |
| 222 | Protein | VRC6154-ZIKV-prME-L307I |
| 223 | Protein | VRC6155-ZIKV-prME-R2K |
| 224 | Protein | VRC6156-ZIKV-prME-G5S |
| 225 | Protein | VRC6157-ZIKV-prME-N8D |
| 226 | Protein | VRC6158-ZIKV-prME-S16T |
| 227 | Protein | VRC6159-ZIKV-prME-G28S |
| 228 | Protein | VRC6160-ZIKV-prME-A54S |
| 229 | Protein | VRC6161-ZIKV-prME-D87N |
| 230 | Protein | VRC6162-ZIKV-prME-N134D |
| 231 | Protein | VRC6163-ZIKV-prME-T170S |
| 232 | Protein | VRC6164-ZIKV-prME-E177Q |
| 233 | Protein | VRC6165-ZIKV-prME-T160S |
| 234 | Protein | VRC6166-ZIKV-prME-R193K |
| 235 | Protein | VRC6167-ZIKV-prME-P222G |
| 236 | Protein | VRC6168-ZIKV-prME-W225F |
| 237 | Protein | VRC6169-ZIKV-prME-T231S |
| 238 | Protein | VRC6170-ZIKV-prME-K316R |
| 239 | Protein | VRC6171-ZIKV-prME-E320Q |
| Nucleic Acid Sequences | | |
| 240 | Nucleic Acid | VRC4974-CMVR-(JEV-SA)Zika-PF2013-prM-E |
| 241 | Nucleic Acid | VRC4975-CMVR-(mIg-SA)Zika-PF2013-prM-E |
| 242 | Nucleic Acid | VRC4976-CMVR-Zika-PF2013-prM-E |
| 243 | Nucleic Acid | VRC4977-CMVR-(JEV-SA)Zika-PF2013-E |
| 244 | Nucleic Acid | VRC4978-CMVR-(mIg-SA)Zika-PF2013-E |
| 245 | Nucleic Acid | VRC4979-CMVR-Zika-PF2013-E |
| 246 | Nucleic Acid | VRC4980-CMVR-Zika-PF2013-E-DTM-Avi3chis |
| 247 | Nucleic Acid | VRC4983-CMVR-Zika-PF2013-E-DTM |
| 248 | Nucleic Acid | VRC4984-CMVR-Zika-PF2013-E-DTM-Avi3chis |
| 249 | Nucleic Acid | VRC5102-CMVR-(JEV-SA)Zika-PF2013-E-DTM |
| 250 | Nucleic Acid | VRC5103-CMVR-(mIg-SA)Zika-PF2013-E-DTM |
| 251 | Nucleic Acid | VRC5104-CMVR-(JEV-SA)Zika-PF2013-E-DFP1 |
| 252 | Nucleic Acid | VRC5105-CMVR-(JEV-SA)Zika-PF2013-E-DFP2 |
| 253 | Nucleic Acid | VRC5106-CMVR-(JEV-SA)Zika-PF2013-E-DFP1-DTM |
| 254 | Nucleic Acid | VRC5107-CMVR-(JEV-SA)Zika-PF2013-E-DFP2-DTM |

TABLE 3-continued

Exemplary amino acid and nucleic acid sequences of modified polyproteins.

| SEQ ID NO. | Molecule | Comments |
|---|---|---|
| 255 | Nucleic Acid | VRC5108-CMVR-(JEV-SA)Zika-PF2013-E-DFP1-DTM-Avi3chis |
| 256 | Nucleic Acid | VRC5109-CMVR-(JEV-SA)Zika-PF2013-E-DFP2-DTM-Avi3chis |
| 257 | Nucleic Acid | VRC5110-CMVR-(JEV-SA)Zika-PF2013-prM-CS1-E |
| 258 | Nucleic Acid | VRC5111-CMVR-(JEV-SA)Zika-PF2013-prM-CS2-E |
| 259 | Nucleic Acid | VRC5112-CMVR-(JEV-SA)Zika-PF2013-prM-E-DFP1 |
| 260 | Nucleic Acid | VRC5113-CMVR-(JEV-SA)Zika-PF2013-prM-E-DFP2 |
| 261 | Nucleic Acid | VRC5114-CMVR-(JEV-SA)Zika-PF2013-prM-CS1-E-DFP1 |
| 262 | Nucleic Acid | VRC5115-CMVR-(JEV-SA)Zika-PF2013-prM-CS2-E-DFP1 |
| 263 | Nucleic Acid | VRC5116-CMVR-(JEV-SA)Zika-PF2013-prM-CS1-E-DFP2 |
| 264 | Nucleic Acid | VRC5117-CMVR-(JEV-SA)Zika-PF2013-prM-CS2-E-DFP2 |
| 265 | Nucleic Acid | VRC5118-CMVR-(JEV-SA)Zika-PF2013-prM-CS1-E-DFP1-DTM |
| 266 | Nucleic Acid | VRC5119-CMVR-(JEV-SA)Zika-PF2013-prM-052-E-DFP1-DTM |
| 267 | Nucleic Acid | VRC5120-CMVR-(JEV-SA)Zika-PF2013-prM-CS1-E-DFP2-DTM |
| 268 | Nucleic Acid | VRC5121-CMVR-(JEV-SA)Zika-PF2013-prM-052-E-DFP2-DTM |
| 269 | Nucleic Acid | VRC5122-JEVss-prM-E_WNV_Stem/TM |
| 270 | Nucleic Acid | VRC5123-pCMV/R-JEVss-ZIKV.PF2013.prME80-JEV.SA14.E20 |
| 271 | Nucleic Acid | VRC5124-JEVss-E_WNV_Stem/TM |
| 272 | Nucleic Acid | VRC5125-JEVss-E_JEV_Stem/TM |
| 273 | Nucleic Acid | VRC5126-JEVss-prM-E_DENV4_Stem/TM |
| 274 | Nucleic Acid | VRC5127-JEVss-E_DENV4_Stem/TM |
| 275 | Nucleic Acid | VRC5131-DENV1 16007 JEVss-prM-E80-V5His |
| 276 | Nucleic Acid | VRC5132-DENV2_New_Guinea_C_JEVss-prM-E80-V5His |
| 277 | Nucleic Acid | VRC5133-WNV_NY99_JEVss-prM-E80-V5His |
| 278 | Nucleic Acid | VRC5134-Zika_H_PF_2013_JEVss-prM-E80-V5His |
| 279 | Nucleic Acid | VRC5135-DENV1 16007 JEVss-prM-E80W101R-V5His |
| 280 | Nucleic Acid | VRC5136-DENV2_New_Guinea_C_JEVss-prM-E80W101R-V5His |
| 281 | Nucleic Acid | VRC5137-WNV_NY99_JEVss-prM-E80W101R-V5His |
| 282 | Nucleic Acid | VRC5138-Zika_H_PF_2013_JEVss-prM-E80W101R-V5His |
| 283 | Nucleic Acid | VRC5220-CMVR-(JEV-ss)Zika-PF2013-(+3AA)prM-E |
| 284 | Nucleic Acid | VRC5221-pcDNA3.1-ZIKV_ArB7701_CprME |
| 285 | Nucleic Acid | VRC5222-pcDNA3.1-ZIKV_ArB7701_prME |
| 286 | Nucleic Acid | VRC5223-pcDNA3.1-ZIKV_ArD7117_CprME |
| 287 | Nucleic Acid | VRC5224-pcDNA3.1-ZIKV_ArD7117_prME |

TABLE 3-continued

Exemplary amino acid and nucleic acid sequences of modified polyproteins.

| SEQ ID NO. | Molecule | Comments |
|---|---|---|
| 288 | Nucleic Acid | VRC5225-pcDNA3.1-ZIKV_MR766-CHO_CprME |
| 289 | Nucleic Acid | VRC5226-pcDNA3.1-ZIKV_MR766-CHO_prME |
| 290 | Nucleic Acid | VRC5227-pcDNA3.1-ZIKV_MR766 + CHO_CprME |
| 291 | Nucleic Acid | VRC5228-pcDNA3.1-ZIKV_MR766 + CHO_prME |
| 292 | Nucleic Acid | VRC5229-pcDNA3.1-ZIKV_PHL2012_CprME |
| 293 | Nucleic Acid | VRC5230-pcDNA3.1-ZIKV_PHL2012_prME |
| 294 | Nucleic Acid | VRC5231-pcDNA3.1-ZIKV_THA2014_CprME |
| 295 | Nucleic Acid | VRC5232-pcDNA3.1-ZIKV_THA2014_prME |
| 296 | Nucleic Acid | VRC5233-pcDNA3.1-Zika_HPF2013 CprME + CHO mut |
| 297 | Nucleic Acid | VRC5234-pcDNA3.1-Zika_HPF2013 CprME + WNV loop + CHO mut |
| 298 | Nucleic Acid | VRC5235-pcDNA3.1-Zika_HPF2013 CprME + DV1 loop + CHO mut |
| 299 | Nucleic Acid | VRC5236-pcDNA3.1-Zika_HPF2013 CprME + DV2 loop + CHO mut |
| 300 | Nucleic Acid | VRC5237-pcDNA3.1-WNV NY99 CprME + Zika HPF2013 loop + CHO mut |
| 301 | Nucleic Acid | VRC5238-pcDNA3.1-DV1 16007 CprME + Zika HPF2013 loop + CHO mut |
| 302 | Nucleic Acid | VRC5239-pcDNA3.1-DV2 16681 CprME + Zika HPF2013 loop + CHO mut |
| 303 | Nucleic Acid | VRC5240-pcDNA3.1-Zika_HPF2013 CprME + WNV loop |
| 304 | Nucleic Acid | VRC5241-pcDNA3.1-Zika_HPF2013 CprME + DV1 loop |
| 305 | Nucleic Acid | VRC5242-pcDNA3.1-Zika_HPF2013 CprME + DV2 loop |
| 306 | Nucleic Acid | VRC5243-pcDNA3.1-WNV NY99 CprME + Zika_HPF2013 loop |
| 307 | Nucleic Acid | VRC5244-pcDNA3.1-DV1 16007 CprME + Zika_HPF2013 loop |
| 308 | Nucleic Acid | VRC5245-pcDNA3.1-DV2 16681 CprME + Zika_HPF2013 loop |
| 309 | Nucleic Acid | VRC5271-CMV/R-ZIKV_ArB7701_CprME |
| 310 | Nucleic Acid | VRC5272-CMV/R-ZIKV_ArB7701_prME |
| 311 | Nucleic Acid | VRC5273-CMV/R-ZIKV_ArD7117_CprME |
| 312 | Nucleic Acid | VRC5274-CMV/R-ZIKV_ArD7117_prME |
| 313 | Nucleic Acid | VRC5275-CMV/R-ZIKV_MR766-CHO_CprME |
| 314 | Nucleic Acid | VRC5276-CMV/R-ZIKV_MR766-CHO_prME |
| 315 | Nucleic Acid | VRC5277-CMV/R-ZIKV_MR766 + CHO_CprME |
| 316 | Nucleic Acid | VRC5278-CMV/R-ZIKV_MR766 + CHO_prME |
| 317 | Nucleic Acid | VRC5279-CMV/R-ZIKV_PHL2012_CprME |
| 318 | Nucleic Acid | VRC5280-CMV/R-ZIKV_PHL2012_prME |
| 319 | Nucleic Acid | VRC5281-CMV/R-ZIKV_THA2014_CprME |
| 320 | Nucleic Acid | VRC5282-CMV/R-ZIKV_THA2014_prME |

TABLE 3-continued

Exemplary amino acid and nucleic acid sequences of modified polyproteins.

| SEQ ID NO. | Molecule | Comments |
|---|---|---|
| 321 | Nucleic Acid | VRC5283-CMVR-(JEV-SA)Zika-PF2013-prM-w12Gat vector |
| 322 | Nucleic Acid | VRC5284-CMVR-(JEV-SA)Zika-PF2013-EA275V-DTM |
| 323 | Nucleic Acid | VRC5285-JEVss-prM-EA275V_JEV_Stem/TM |
| 324 | Nucleic Acid | VRC5286-CMVR-(JEV-ss)Zika-PF2013-(+3AA)prM-EA275V |
| 325 | Nucleic Acid | VRC5288-pCMV/R-JEVss-AEV-ZIKV.PF2013.prME80-JEV.SA14.E20 |
| 326 | Nucleic Acid | VRC5289-pCMV/R-JEVss-ZIKV.PF2013.prME80.A275V-JEV.SA14.E20 |
| 327 | Nucleic Acid | VRC5290-pCMV/R-JEVss-AEV-ZIKV.PF2013.prME80.A275V-JEV.SA14.E20 |
| 328 | Nucleic Acid | VRC5291-pCMV/R-KZ.gc-JEVss-AEV-ZIKV.PF2013.prME80-JEV.SA14.E20 |
| 329 | Nucleic Acid | VRC5292-pCMV/R-JEVss-ZIKV.PF2013.prME80-ZIKV.MR766.E20 |
| 330 | Nucleic Acid | VRC5293-pCMV/R-JEVss-ZIKV.PF2013.prM50E80-ZIKV.MR766.M50E20 |
| 331 | Nucleic Acid | VRC5294-pCMV/R-JEVss-ZIKV.PF2013.prM30E80-ZIKV.MR766.M70E20 |
| 332 | Nucleic Acid | VRC5295-pCMV/R-hCD5ss-AEV-ZIKV.PF2013.prME80-JEV.SA14.E20 |
| 333 | Nucleic Acid | VRC5296-pCMV/R-hCD5ss-ZIKV.PF2013.prME |
| 334 | Nucleic Acid | VRC5296-pCMV/R-hCD5ss-ZIKV.PF2013.prME.A275V |
| 335 | Nucleic Acid | VRC5299-pCMV/R-hCD5ss-ZIKV.PF2013.prME |
| 336 | Nucleic Acid | VRC5450_KZ-gc-JEVss-AEV-PFwt_VRCZIKA_BR_wt_optimized |
| 337 | Nucleic Acid | VRC5451_KZ-gc-JEVss-AEV-PF-pr22-pr72_VRCZIKA_BR_1_optimized |
| 338 | Nucleic Acid | VRC5452_KZ-gc-JEVss-AEV-PF-furinA_VRCZIKA_BR_2_optimized |
| 339 | Nucleic Acid | VRC5453_KZ-gc-JEVss-AEV-PF-furinB_VRCZIKA_BR_3_optimized |
| 340 | Nucleic Acid | VRC5454_KZ-gc-JEVss-AEV-PF-furinC_VRCZIKA_BR_4_optimized |
| 341 | Nucleic Acid | VRC5455_KZ-gc-JEVss-AEV-PF-furinD_VRCZIKA_BR_5_optimized |
| 342 | Nucleic Acid | VRC5456_KZ-gc-JEVss-AEV-PF-furinE_VRCZIKA_BR_6_optimized |
| 343 | Nucleic Acid | VRC5457_KZ-gc-JEVss-AEV-PF-furinF_VRCZIKA_BR_7_optimized |
| 344 | Nucleic Acid | VRC5458_KZ-gc-JEVss-AEV-PF-furinG_VRCZIKA_BR_8_optimized |
| 345 | Nucleic Acid | VRC5459_KZ-gc-JEVss-AEV-PF-furinH_VRCZIKA_BR_9_optimized |
| 346 | Nucleic Acid | VRC5460_KZ-gc-JEVss-AEV-PF-fusionA_VRCZIKA_BR_10_optimized |
| 347 | Nucleic Acid | VRC5461_KZ-gc-JEVss-AEV-PF-fusionB_VRCZIKA_BR_11_optimized |
| 348 | Nucleic Acid | VRC5462_KZ-gc-JEVss-AEV-PF-fusionC_VRCZIKA_BR_12_optimized |
| 349 | Nucleic Acid | VRC5463_KZ-gc-JEVss-AEV-PF-fusionD_VRCZIKA_BR_13_optimized |
| 350 | Nucleic Acid | VRC5464_KZ-gc-JEVss-AEV-PF-fusionE_VRCZIKA_BR_14_optimized |
| 351 | Nucleic Acid | VRC5465_KZ-gc-JEVss-AEV-PF-E275_VRCZIKA_BR_15_optimized |
| 352 | Nucleic Acid | VRC5466_KZ-gc-JEVss-AEV-PF-linkWNV_VRCZIKA_BR_16_optimized |
| 353 | Nucleic Acid | VRC5467_KZ-gc-JEVss-AEV-PF-stemWNV_VRCZIKA_BR_17_optimized |

TABLE 3-continued

Exemplary amino acid and nucleic acid sequences of modified polyproteins.

| SEQ ID NO. | Molecule | Comments |
|---|---|---|
| 354 | Nucleic Acid | VRC5468_KZ-gc-JEVss-AEV-PF-E20WNV_VRCZIKA_BR_18_optimized |
| 355 | Nucleic Acid | VRC5469_KZ-gc-JEVss-AEV-PF-E20JEV_VRCZIKA_BR_19_optimized |
| 356 | Nucleic Acid | VRC5470_KZ-gc-JEVss-AEV-PF-stem + WNV_VRCZIKA_BR_20_optimized |
| 357 | Nucleic Acid | VRC5471_KZ-gc-JEVss-AEV-PF-stem + JEV_VRCZIKA_BR_21_optimized |
| 358 | Nucleic Acid | VRC5472_KZ-gc-JEVss-AEV-PF-ptstemWNV_VRCZIKA_BR_22_optimized |
| 359 | Nucleic Acid | VRC5473_KZ-gc-JEVss-AEV-PF-ptstemJEV_VRCZIKA_BR_23_optimized |
| 360 | Nucleic Acid | VRC5474_KZ-gc-JEVss-AEV-PF-2Eaas_VRCZIKA_BR_24_optimized |
| 361 | Nucleic Acid | VRC5475_KZ-gc-JEVss-AEV-PF-glycE64_VRCZIKA_BR_25_optimized |
| 362 | Nucleic Acid | VRC5476_KZ-gc-JEVss-AEV-PF-glycE68_VRCZIKA_BR_26_optimized |
| 363 | Nucleic Acid | VRC5477_KZ-gc-JEVss-AEV-PF-comb1-4-10-15-16-19-26_VRCZIKA_BR_27_optimized |
| 364 | Nucleic Acid | VRC5478_KZ-gc-JEVss-AEV-PF-comb1-8-10-15-16-19-26_VRCZIKA_BR_28_optimized |
| 365 | Nucleic Acid | VRC5479_KZ-gc-JEVss-AEV-PF-comb1-4-13-15-16-19-26_VRCZIKA_BR_29_optimized |
| 366 | Nucleic Acid | VRC5480_KZ-gc-JEVss-AEV-PF-comb1-4-10-15-16-18-26_VRCZIKA_BR_30_optimized |
| 367 | Nucleic Acid | VRC5481_KZ-gc-JEVss-AEV-PF-comb1-4-10-14-16-19-26_VRCZIKA_BR_31_optimized |
| 368 | Nucleic Acid | VRC5482_KZ-gc-JEVss-AEV-PF-comb1-4-10-15-16-22-26_VRCZIKA_BR_32_optimized |
| 369 | Nucleic Acid | VRC5483_KZ-gc-JEVss-AEV-PF-comb4-10_VRCZIKA_BR_33_optimized |
| 370 | Nucleic Acid | VRC5484_KZ-gc-JEVss-AEV-PF-comb4-19_VRCZIKA_BR_34_optimized |
| 371 | Nucleic Acid | VRC5485_KZ-gc-JEVss-AEV-PF-comb4-26_VRCZIKA_BR_35_optimized |
| 372 | Nucleic Acid | VRC5486_KZ-gc-JEVss-AEV-PF-comb10-16_VRCZIKA_BR_36_optimized |
| 373 | Nucleic Acid | VRC5487_KZ-gc-JEVss-AEV-PF-comb10-19_VRCZIKA_BR_37_optimized |
| 374 | Nucleic Acid | VRC5488_KZ-gc-JEVss-AEV-PF-comb19-26_VRCZIKA_BR_38_optimized |
| 375 | Nucleic Acid | VRC5489_KZ-gc-JEVss-AEV-PF-comb16-19_VRCZIKA_BR_39_optimized |
| 376 | Nucleic Acid | VRC5490_KZ-gc-JEVss-AEV-PF-comb15-19_VRCZIKA_BR_40_optimized |
| 377 | Nucleic Acid | VRC5491_KZ-gc-JEVss-AEV-PF-UgandaA_VRCZIKA_BR_41_optimized |
| 378 | Nucleic Acid | VRC5492_KZ-gc-JEVss-AEV-PF-UgandaB_VRCZIKA_BR_42_optimized |
| 379 | Nucleic Acid | VRC5493_diffKZ-gc-JEVss-AEV-PF-E20JEV_VRCZIKA_BR_43_optimized |
| 380 | Nucleic Acid | VRC6101-ZIKV-prME-G106R |
| 381 | Nucleic Acid | VRC6102-ZIKV-prME-L107D |
| 382 | Nucleic Acid | VRC6103-ZIKV-prME-G106R, L107D |
| 383 | Nucleic Acid | VRC6104-ZIKV-prME-T76A, Q77G, W101R |
| 384 | Nucleic Acid | VRC6105-ZIKV-prME-T76A, Q77G |
| 385 | Nucleic Acid | VRC6106-ZIKV-prME-T76A, Q77G, G106R, L107D, W101R |
| 386 | Nucleic Acid | VRC6107-ZIKV-prME-G106R, L107D, W101R |
| 387 | Nucleic Acid | VRC6108-ZIKV-prME-T76A |
| 388 | Nucleic Acid | VRC6109-ZIKV-prME-Q77G |

TABLE 3-continued

Exemplary amino acid and nucleic acid sequences of modified polyproteins.

| SEQ ID NO. | Molecule | Comments |
|---|---|---|
| 389 | Nucleic Acid | VRC6110-ZIKV-prME-W101R |
| 390 | Nucleic Acid | VRC6111-ZIKV-prME-K251A |
| 391 | Nucleic Acid | VRC6112-ZIKV-prME-Q253A |
| 392 | Nucleic Acid | VRC6113-ZIKV-prME-H266A |
| 393 | Nucleic Acid | VRC6114-ZIKV-prME-E262A |
| 394 | Nucleic Acid | VRC6115-ZIKV-prME-V255A |
| 395 | Nucleic Acid | VRC6116-ZIKV-prME-V256A |
| 396 | Nucleic Acid | VRC6117-ZIKV-prME-V257A |
| 397 | Nucleic Acid | VRC6118-ZIKV-prME-Q261A |
| 398 | Nucleic Acid | VRC6119-ZIKV-prME-D296A |
| 399 | Nucleic Acid | VRC6120-ZIKV-prME-K297A |
| 400 | Nucleic Acid | VRC6121-ZIKV-prME-L300A |
| 401 | Nucleic Acid | VRC6122-ZIKV-prME-S304A |
| 402 | Nucleic Acid | VRC6123-ZIKV-prME-Y305A |
| 403 | Nucleic Acid | VRC6124-ZIKV-prME-L307A |
| 404 | Nucleic Acid | VRC6125-ZIKV-prME-R2A |
| 405 | Nucleic Acid | VRC6126-ZIKV-prME-G5A |
| 406 | Nucleic Acid | VRC6127-ZIKV-prME-N8A |
| 407 | Nucleic Acid | VRC6128-ZIKV-prME-S16A |
| 408 | Nucleic Acid | VRC6129-ZIKV-prME-G28A |
| 409 | Nucleic Acid | VRC6130-ZIKV-prME-A54G |
| 410 | Nucleic Acid | VRC6131-ZIKV-prME-D87A |
| 411 | Nucleic Acid | VRC6132-ZIKV-prME-N134A |
| 412 | Nucleic Acid | VRC6133-ZIKV-prME-T170A |
| 413 | Nucleic Acid | VRC6134-ZIKV-prME-E177A |
| 414 | Nucleic Acid | VRC6135-ZIKV-prME-T160A |
| 415 | Nucleic Acid | VRC6136-ZIKV-prME-R193A |
| 416 | Nucleic Acid | VRC6137-ZIKV-prME-P222A |
| 417 | Nucleic Acid | VRC6138-ZIKV-prME-W22SA |
| 418 | Nucleic Acid | VRC6139-ZIKV-prME-T231A |
| 419 | Nucleic Acid | VRC6140-ZIKV-prME-K316A |
| 420 | Nucleic Acid | VRC6141-ZIKV-prME-E320A |
| 421 | Nucleic Acid | VRC6142-ZIKV-prME-K251R |
| 422 | Nucleic Acid | VRC6143-ZIKV-prME-Q253E |
| 423 | Nucleic Acid | VRC6144-ZIKV-prME-E262Q |
| 424 | Nucleic Acid | VRC6145-ZIKV-prME-V255I |
| 425 | Nucleic Acid | VRC6146-ZIKV-prME-V256I |

TABLE 3-continued

Exemplary amino acid and nucleic acid sequences of modified polyproteins.

| SEQ ID NO. | Molecule | Comments |
|---|---|---|
| 426 | Nucleic Acid | VRC6147-ZIKV-prME-V257I |
| 427 | Nucleic Acid | VRC6148-ZIKV-prME-Q261E |
| 428 | Nucleic Acid | VRC6149-ZIKV-prME-D296N |
| 429 | Nucleic Acid | VRC6150-ZIKV-prME-K297R |
| 430 | Nucleic Acid | VRC6151-ZIKV-prME-L300I |
| 431 | Nucleic Acid | VRC6152-ZIKV-prME-S304T |
| 432 | Nucleic Acid | VRC6153-ZIKV-prME-Y305F |
| 433 | Nucleic Acid | VRC6154-ZIKV-prME-L307I |
| 434 | Nucleic Acid | VRC6155-ZIKV-prME-R2K |
| 435 | Nucleic Acid | VRC6156-ZIKV-prME-G5S |
| 436 | Nucleic Acid | VRC6157-ZIKV-prME-N8D |
| 437 | Nucleic Acid | VRC6158-ZIKV-prME-S16T |
| 438 | Nucleic Acid | VRC6159-ZIKV-prME-G28S |
| 439 | Nucleic Acid | VRC6160-ZIKV-prME-A54S |
| 440 | Nucleic Acid | VRC6161-ZIKV-prME-D87N |
| 441 | Nucleic Acid | VRC6162-ZIKV-prME-N134D |
| 442 | Nucleic Acid | VRC6163-ZIKV-prME-T170S |
| 443 | Nucleic Acid | VRC6164-ZIKV-prME-E177Q |
| 444 | Nucleic Acid | VRC6165-ZIKV-prME-T160S |
| 445 | Nucleic Acid | VRC6166-ZIKV-prME-R193K |
| 446 | Nucleic Acid | VRC6167-ZIKV-prME-P222G |
| 447 | Nucleic Acid | VRC6168-ZIKV-prME-W225F |
| 448 | Nucleic Acid | VRC6169-ZIKV-prME-T231S |
| 449 | Nucleic Acid | VRC6170-ZIKV-prME-K316R |
| 450 | Nucleic Acid | VRC6171-ZIKV-prME-E320Q |

In one embodiment, the fusion protein comprises an amino acid sequence of a modified protein Listed in Table 3. In one embodiment, the fusion protein comprises an amino acid sequence at least 85% identical, at least 90% identical, at least 95% identical, at least 97% identical, or at least 99% identical, to protein comprising an amino acid sequence selected from the group consisting of SEQ ID NO:29-239. In one embodiment, the fusion protein comprises an amino acid sequence comprising an amino acid sequence selected from the group consisting of SEQ ID NO:23-239.

One embodiment of the invention is a modified Zika virus envelope protein in which the stem region, the transmembrane region, or both (the stem/transmembrane region) has been replaced with the corresponding region from the envelope protein of another flavivirus. In one embodiment, the stem region, the transmembrane region, or both (the stem/transmembrane region) has been replaced with the corresponding region from a flavivirus selected from the group consisting of Dengue virus, Japanese Encephalitis Virus, Murray Valley Encephalitis Virus, St. Louis Encephalitis Virus, West Nile Virus, and Yellow Fever Virus. In one embodiment, the stem region, the transmembrane region, or both (the stem/transmembrane region) has been replaced with the corresponding region from Japanese Encephalitis Virus.

One embodiment of the invention is a modified Zika virus envelope protein in which a region of the envelope protein corresponding to SEQ ID NO:6, SEQ ID NO:10 or SEQ ID NO:14, has been replaced with a corresponding region from the envelope protein of a flavivirus selected from the group consisting of Dengue virus, Japanese Encephalitis Virus, Murray Valley Encephalitis Virus, St. Louis Encephalitis Virus, West Nile Virus, and Yellow Fever Virus. In one embodiment, the region corresponding to SEQ ID NO:6, SEQ ID NO:10 or SEQ ID NO:14, has been replaced with a corresponding region from the envelope protein of Japanese Encephalitis Virus.

One embodiment of the invention is a modified Zika virus envelope protein in which a region of the envelope protein comprising SEQ ID NO:6, SEQ ID NO:10 or SEQ ID NO:14, has been replaced with a corresponding region from the envelope protein of a flavivirus selected from the group consisting of Dengue virus, Japanese Encephalitis Virus, Murray Valley Encephalitis Virus, St. Louis Encephalitis Virus, West Nile Virus, and Yellow Fever Virus. In one embodiment, a region of the envelope protein comprising SEQ ID NO:6, SEQ ID NO:10 or SEQ ID NO:14, has been replaced with a corresponding region from the envelope protein of Japanese Encephalitis Virus.

One embodiment of the invention is a modified Zika virus envelope protein in which the stem region has been replaced with the corresponding region from Japanese Encephalitis Virus envelope protein. In one embodiment, the region of the envelope protein corresponding to SEQ ID NO:6 has been replaced with an amino acid sequence at least 85% identical, at least 90% identical, at least 95% identical, at least 97% identical, or at least 99% identical, to SEQ ID NO:8. In one embodiment, the region of the envelope protein comprising SEQ ID NO:6 has been replaced with an amino acid sequence at least 85% identical, at least 90% identical, at least 95% identical, at least 97% identical, or at least 99% identical, to SEQ ID NO:8. In one embodiment, the region of the envelope protein corresponding to SEQ ID NO:6 has been replaced with SEQ ID NO:8. In one embodiment, a region of the envelope protein comprising SEQ ID NO:6 has been replaced with SEQ ID NO:8.

One embodiment of the invention is a modified Zika virus envelope protein in which the transmembrane region has been replaced with the corresponding region from Japanese Encephalitis Virus envelope protein. In one embodiment, the region of the envelope protein corresponding to SEQ ID NO:10 has been replaced with an amino acid sequence at least 85% identical, at least 90% identical, at least 95% identical, at least 97% identical, or at least 99% identical, to SEQ ID NO:12. In one embodiment, the region of the envelope protein comprising SEQ ID NO:10 has been replaced with an amino acid sequence at least 85% identical, at least 90% identical, at least 95% identical, at least 97% identical, or at least 99% identical, to SEQ ID NO:12. In one embodiment, the region of the envelope protein corresponding to SEQ ID NO:10 has been replaced with SEQ ID NO:12. In one embodiment, the region of the envelope protein comprising SEQ ID NO:10 has been replaced with SEQ ID NO:12.

One embodiment of the invention is a modified Zika virus envelope protein in which the stem/transmembrane region has been replaced with the corresponding region from Japanese Encephalitis Virus envelope protein. In one embodiment, the region of the envelope protein corresponding to SEQ ID NO:14 has been replaced with an amino acid sequence at least 85% identical, at least 90% identical, at least 95% identical, at least 97% identical, or at least 99% identical, to SEQ ID NO:16. In one embodiment, the region of the envelope protein comprising SEQ ID NO:14 has been replaced with an amino acid sequence at least 85% identical, at least 90% identical, at least 95% identical, at least 97% identical, or at least 99% identical, to SEQ ID NO:16. In one embodiment, the region of the envelope protein corresponding to SEQ ID NO:14 has been replaced with SEQ ID NO:16. In one embodiment, the region of the envelope protein comprising SEQ ID NO:14 has been replaced with SEQ ID NO:16.

The inventors have discovered that certain mutations in Zika virus structural proteins can alter the characteristics (e.g., yield, stability, immunogenicity, etc.) of VLPs comprising such proteins. Thus, in one embodiment, a fusion protein of the invention comprises one or more mutations that increase the yield, stability of immunogenicity of VLPs comprising the mutated structural protein. In one embodiment, a fusion protein of the invention comprises a Zika virus structural protein comprising one or more mutations from a modified protein listed in Table 1.

One embodiment of the invention is protein comprising an amino acid sequence at least 85% identical, at least 90% identical, at least 95% identical, at least 97% identical, or at least 99% identical, to the amino acid sequence of a modified protein listed in Table 1. Table 1 lists the sequences of modified polyproteins, some of which contain site specific mutations such as substitution mutations meant to alter the stability or immunogenicity, for example, of VLPs made from such proteins. Thus, those skilled in the art will understand that proteins having some percent identity with the sequences listed in Table 3, will contain the mutations of the sequence to which they are being compared. For example, a protein having some identity with SEQ ID NO:192, will still contain a leucine to alanine substitution at the amino acid position corresponding to position 305. Thus, one embodiment of the invention is protein comprising an amino acid sequence at least 85% identical, at least 90% identical, at least 95% identical, at least 97% identical, or at least 99% identical, to the amino acid sequence of a modified protein listed in Table 1, wherein the protein comprises the one or more mutations present in the modified protein having a sequence selected from the group consisting of SEQ ID NO:29-239. One embodiment of the invention is protein comprising an amino acid sequence of a modified protein listed in Table 3. One embodiment of the invention is protein comprising an amino acid sequence at least 85% identical, at least 90% identical, at least 95% identical, at least 97% identical, or at least 99% identical, to the amino acid sequence of a modified protein having a sequence selected from the group consisting of SEQ ID NO:29-239, wherein the protein comprises the one or more mutations present in the modified protein having a sequence selected from the group consisting of SEQ ID NO:29-239. In one embodiment, a protein of the invention comprises an amino acid sequence of a modified protein having a sequence selected from the group consisting of SEQ ID NO:29-239.

VLPS

As has been discussed, proteins of the invention are capable of forming virus-like particles (VLPs) that elicit an immune response to Zika virus. Preferred VLPs are those that display on their surface epitopes that elicit an immune response to Zika virus. Thus, one embodiment of the invention is a virus-like particle (VLP) comprising a protein encoded by one or more nucleic acid molecules of the invention. One embodiment of the invention is a VLP comprising one or more proteins of the invention. One embodiment of the invention is a VLP comprising a membrane and/or envelope protein of the invention.

One embodiment of the invention is VLP comprising a modified Zika virus envelope protein in which the stem region, the transmembrane region, or both (the stem/transmembrane region) has been replaced with the corresponding region from the envelope protein of another flavivirus. In one embodiment, the stem region, the transmembrane region, or both (the stem/transmembrane region) has been replaced with the corresponding region from a flavivirus selected from the group consisting of Dengue virus, Japanese Encephalitis Virus, Murray Valley Encephalitis Virus, St. Louis Encephalitis Virus, West Nile Virus, and Yellow Fever Virus. In one embodiment, the stem region, the transmembrane region, or both (the stem/transmembrane region) has been replaced with the corresponding region from Japanese Encephalitis Virus. In one embodiment, the VLP comprises a modified Zika virus envelope protein in which a region of the envelope protein corresponding to SEQ ID NO:6, SEQ ID NO:10 or SEQ ID NO:14, has been replaced with a corresponding region from the envelope protein of a flavivirus selected from the group consisting of Dengue virus, Japanese Encephalitis Virus, Murray Valley Encephalitis Virus, St. Louis Encephalitis Virus, West Nile Virus, and Yellow Fever Virus. In one embodiment, the VLP comprises a modified Zika virus envelope protein in which a corresponding to SEQ ID NO:6, SEQ ID NO:10 or SEQ ID NO:14, has been replaced with a corresponding region from the envelope protein of Japanese Encephalitis Virus.

In one embodiment, the VLP comprises a modified Zika virus envelope protein in which a region of the envelope protein comprising SEQ ID NO:6, SEQ ID NO:10 or SEQ ID NO:14, has been replaced with a corresponding region from the envelope protein of a flavivirus selected from the group consisting of Dengue virus, Japanese Encephalitis Virus, Murray Valley Encephalitis Virus, St. Louis Encephalitis Virus, West Nile Virus, and Yellow Fever Virus. In one embodiment, the VLP comprises a modified Zika virus envelope protein in which a region of the envelope protein comprising SEQ ID NO:6, SEQ ID NO:10 or SEQ ID NO:14, has been replaced with a corresponding region from the envelope protein of Japanese Encephalitis Virus.

In one embodiment, the VLP comprises a modified Zika virus envelope protein in which the stem region has been replaced with the corresponding region from Japanese Encephalitis Virus envelope protein. In one embodiment, the VLP comprises a modified Zika virus envelope protein in which the region of the envelope protein corresponding to SEQ ID NO:6 has been replaced with an amino acid sequence at least 85% identical, at least 90% identical, at least 95% identical, at least 97% identical, or at least 99% identical, to SEQ ID NO:8. In one embodiment, the VLP comprises a modified Zika virus envelope protein in which the region of the envelope protein comprising SEQ ID NO:6 has been replaced with an amino acid sequence at least 85% identical, at least 90% identical, at least 95% identical, at least 97% identical, or at least 99% identical, to SEQ ID NO:8. In one embodiment, the VLP comprises a modified Zika virus envelope protein in which the region of the envelope protein corresponding to SEQ ID NO:6 has been replaced with SEQ ID NO:8. In one embodiment, the VLP comprises a modified Zika virus envelope protein in which portion of the envelope protein comprising SEQ ID NO:6 has been replaced with SEQ ID NO:8.

One embodiment of the invention is a VLP comprising a modified Zika virus envelope protein in which the transmembrane region has been replaced with the corresponding region from Japanese Encephalitis Virus envelope protein. In one embodiment, the VLP comprises a modified Zika virus envelope protein in which the region of the envelope protein corresponding to SEQ ID NO:10 has been replaced with an amino acid sequence at least 85% identical, at least 90% identical, at least 95% identical, at least 97% identical, or at least 99% identical, to SEQ ID NO:12. In one embodiment, the VLP comprises a modified Zika virus envelope protein in which the portion of the envelope protein comprising SEQ ID NO:10 has been replaced with an amino acid sequence at least 85% identical, at least 90% identical, at least 95% identical, at least 97% identical, or at least 99% identical, to SEQ ID NO:12. In one embodiment, the VLP comprises a modified Zika virus envelope protein in which the region of the envelope protein corresponding to SEQ ID NO:10 has been replaced with SEQ ID NO:12. In one embodiment, the VLP comprises a modified Zika virus envelope protein in which the portion of the envelope protein comprising SEQ ID NO:10 has been replaced with SEQ ID NO:12.

One embodiment of the invention is a VLP comprising a modified Zika virus envelope protein in which the stem/transmembrane region has been replaced with the corresponding region from Japanese Encephalitis Virus envelope protein. In one embodiment, the VLP comprises a modified Zika virus envelope protein in which the region of the envelope protein corresponding to SEQ ID NO:14 has been replaced with an amino acid sequence at least 85% identical, at least 90% identical, at least 95% identical, at least 97% identical, or at least 99% identical, to SEQ ID NO:16. In one embodiment, the VLP comprises a modified Zika virus envelope protein in which the portion of the envelope protein comprising SEQ ID NO:14 has been replaced with an amino acid sequence at least 85% identical, at least 90% identical, at least 95% identical, at least 97% identical, or at least 99% identical, to SEQ ID NO:16. In one embodiment, the VLP comprises a modified Zika virus envelope protein in which the region of the envelope protein corresponding to SEQ ID NO:14 has been replaced with SEQ ID NO:16. In one embodiment, the VLP comprises a modified Zika virus envelope protein in which the portion of the envelope protein comprising SEQ ID NO:14 has been replaced with SEQ ID NO:16.

As previously discussed, mutations (e.g., substitution mutations) in specific locations in Zika virus structural proteins can alter the characteristics (e.g., yield, stability, immunogenicity, etc.) of VLPs comprising such proteins. Thus, in one embodiment, the VLP comprises a modified protein of the invention, wherein the protein comprises at least one mutation from a modified protein listed in Table 3. In one embodiment, the VLP comprises a protein comprising an amino acid sequence at least 85% identical, at least 90% identical, at least 95% identical, at least 97% identical, or at least 99% identical, to the amino acid sequence of a modified protein listed in Table 3, wherein the protein comprises the mutation of the modified protein listed in Table 3. In one embodiment, the VLP comprises a protein comprising the amino acid sequence of a modified protein listed in Table 3. In one embodiment, the VLP comprises a protein comprising an amino acid sequence at least 85% identical, at least 90% identical, at least 95% identical, at least 97% identical, or at least 99% identical, to the amino acid sequence of a modified protein having a sequence selected from the group consisting of SEQ ID NO:29-239. In one embodiment, the VLP comprises a protein comprising an amino acid sequence selected from the group consisting of SEQ ID NO:29-239.

In one embodiment, the VLP comprises a modified Zika virus membrane protein. In one embodiment, the modified Zika virus membrane protein comprises a mutation from modified membrane protein listed in Table 3. In one embodiment, the modified Zika virus membrane protein comprise a mutation at a position corresponding to amino acid position H7 in SEQ ID NO:2.

In one embodiment, the VLP comprises a modified Zika virus envelope protein. In one embodiment, the modified Zika virus envelope protein comprises a mutation in the fusion peptide. In one embodiment, the modified Zika virus envelope protein comprises a mutation in the fusion loop. In one embodiment, the modified Zika virus envelope protein comprises a mutation in the M loop. In one embodiment, the modified Zika virus envelope protein comprises a mutation at a location involved in glycosylation. In one embodiment, the modified Zika virus envelope protein comprises a mutation at a location corresponding to a location selected from the group consisting of R2, G5, N8, S16, G28, A54, T76, Q77, D87, W101, G106, L107, N134, T160, T170, E177, R193, P222, W225, T231, K251, Q253, V255, V256, V257, Q261, E262, H266, E262, D296, K297, L300, S304, Y305, L307, K316, and E320, of SEQ ID NO:4.

It will be understood by those skilled in the art that VLPs of the invention can comprise membrane proteins of the invention, and/or envelope proteins of the invention. Thus in one embodiment, a VLP of the invention comprises a modified Zika virus membrane protein and a wild-type Zika virus envelope protein. In one embodiment, a VLP of the invention comprises a wild-type Zika virus membrane protein and a modified Zika virus envelope protein of the invention. In one embodiment, a VLP of the invention comprises a modified Zika virus membrane protein of the invention and a modified Zika virus envelope protein of the invention.

One embodiment of the invention is a virus-like particle produced from introduction of a nucleic acid molecule of the invention into a cell, wherein the virus-like particle comprises a Zika virus envelope protein of the invention and/or a Zika virus membrane protein of the invention.

One embodiment of the invention is a method for producing Zika VLPs, comprising introducing into a cell, a nucleic acid molecule of the invention. In certain embodiment, isolation of VLPs may be desired. In such embodiments, the method further comprises isolating or purifying the VLPs. As used herein, the terms isolate, purify, and the like, do not infer any particular level of percentage or purity. Instead, such terms refer to removing the desired component (e.g., VLPs) from surrounding material (e.g., cell matter) to a degree sufficient for the intended purpose (e.g., laboratory analysis, introduction to tissue culture cells, injection into a person, etc.). Purification methods suitable for an intended purpose are known to those skilled in the art.

In the afore-mentioned embodiments, the VLP can be a reporter virus particle (RVP). Reporter virus particles (RVPs) of the invention can comprise a nucleic acid molecule (e.g., a sub-genomic flavivirus replicon) encoding a reporter molecule enabling monitoring of the replication or expression of the genes found in the nucleic acid molecule. The reporter molecule can also be used to measure the presence of any virus or virus-like particle containing the nucleic acid molecule, and/or the ability of any virus or virus-like particle that contains the nucleic acid molecule to enter a cell (e.g., infectivity). Examples of reporter molecules include, but are not limited to, a fluorescent protein or an enzymatic protein. Examples of enzymatic reporter proteins include, but are not limited to, a luciferase, β-Galactosidase, alkaline phosphatase, chloramphenicol acetyltransferase (CAT), and the like. Examples of fluorescent reporter proteins include, but are not limited to, GFP (green fluorescent protein), RFP (red fluorescent protein), YFP (yellow fluorescent protein), nsTGP, and the like. Examples of luciferase include, but are not limited to renilla luciferase reporter and firefly luciferase reporter. In some embodiments the RPV comprises a nucleic acid molecule that allows for selection of a cell that comprises the nucleic acid sequence. For example, a cell comprising the nucleic acid molecule can be selected for by contacting the cell with a drug (e.g., antibiotic) or chemical that kills cells lacking the nucleic acid molecule. Accordingly, in some embodiments, the nucleic acid molecule comprises a drug resistant gene that allows a cell to escape the effects of drug or chemical. Examples of markers that can be used include, but are not limited to, zeomycin, hygromycin, neomycin, blasticidin, puromycin, or mycophenolic acid resistance markers and antibiotics and the like.

In certain aspects of the invention, RVPs of the invention comprise the afore-mentioned nucleic acid molecule encapsidated by one or more flavivirus structural proteins. In certain embodiments, the nucleic acid molecule is encapsidated by one or more Zika virus structural proteins. In preferred embodiments, the nucleic acid molecule is encapsidated by one or more of the Zika virus structural proteins disclosed herein. Any of the Zika virus structural proteins disclosed herein can be used to make RVPs of the invention, as long as the RPV can attach to and enter a cell. Preferred RPVs are also able to bind anti-Zika virus antibodies.

In certain aspects, a RVP of the invention comprises a modified Zika virus envelope protein in which the stem region, the transmembrane region, or both (the stem/transmembrane region) has been replaced with the corresponding region from the envelope protein of another flavivirus. In one embodiment, the stem region, the transmembrane region, or both (the stem/transmembrane region) has been replaced with the corresponding region from a flavivirus selected from the group consisting of Dengue virus, Japanese Encephalitis Virus, Murray Valley Encephalitis Virus, St. Louis Encephalitis Virus, West Nile Virus, and Yellow Fever Virus. In one embodiment, the stem region, the transmembrane region, or both (the stem/transmembrane region) has been replaced with the corresponding region from Japanese Encephalitis Virus. In one embodiment, the RVP comprises a modified Zika virus envelope protein in which a region of the envelope protein corresponding to SEQ ID NO:6, SEQ ID NO:10 or SEQ ID NO:14, has been replaced with a corresponding region from the envelope protein of a flavivirus selected from the group consisting of Dengue virus, Japanese Encephalitis Virus, Murray Valley Encephalitis Virus, St. Louis Encephalitis Virus, West Nile Virus, and Yellow Fever Virus. In one embodiment, the RVP comprises a modified Zika virus envelope protein in which a corresponding to SEQ ID NO:6, SEQ ID NO:10 or SEQ ID NO:14, has been replaced with a corresponding region from the envelope protein of Japanese Encephalitis Virus.

In certain aspects, a RVP of the invention comprises a modified protein of the invention, wherein the protein comprises at least one mutation from a modified protein listed in Table 3. In one embodiment, the RVP comprises a protein comprising an amino acid sequence at least 85% identical, at least 90% identical, at least 95% identical, at least 97% identical, or at least 99% identical, to the amino acid sequence of a modified protein listed in Table 3, wherein the protein comprises the mutation of the modified protein listed in Table 3. In one embodiment, the RVP comprises a protein comprising the amino acid sequence of a modified protein listed in Table 3. In one embodiment, the RVP comprises a protein comprising an amino acid sequence at least 85% identical, at least 90% identical, at least 95% identical, at least 97% identical, or at least 99% identical, to the amino acid sequence of a modified protein having a sequence selected from the group consisting of SEQ ID NO:29-239. In one embodiment, the RVP comprises a protein comprising an amino acid sequence selected from the group consisting of SEQ ID NO:29-239. In one embodiment, the RVP comprises a modified Zika virus membrane protein. In one embodiment, the modified Zika virus membrane protein comprises a mutation from modified membrane protein listed in Table 3. In one embodiment, the modified Zika virus membrane protein comprise a mutation at a position corresponding to amino acid position H7 in SEQ ID NO:2. In one embodiment, the RVP comprises a modified Zika virus envelope protein. In one embodiment, the modified Zika virus envelope protein comprises a mutation in the fusion peptide. In one embodiment, the modified Zika virus envelope protein comprises a mutation in the fusion loop. In one embodiment, the modified Zika virus envelope protein comprises a mutation in the M loop. In one embodiment, the modified Zika virus envelope protein comprises a mutation at a location involved in glycosylation. In one embodiment, the modified Zika virus envelope protein comprises a mutation at a location corresponding to a location selected from the group consisting of R2, G5, N8, S16, G28, A54, T76, Q77, D87, W101, G106, L107, N134, T160, T170, E177, R193, P222, W225, T231, K251, Q253, V255, V256, V257, Q261, E262, H266, E262, D296, K297, L300, S304, Y305, L307, K316, and E320, of SEQ ID NO:4.

One embodiment of the invention is a pharmaceutical composition comprising a nucleic acid molecule, a protein, or a VLP of the invention. Such compositions are suitable for the therapeutic delivery of nucleic acid molecules, including expression vectors described herein, proteins, or VLPs, of the invention. Hence, the invention provides pharmaceutical compositions that comprise a therapeutically-effective amount of one or more nucleic acid molecules, proteins, or VLPs, described herein, formulated together with one or more pharmaceutically-acceptable carriers (additives) and/or diluents. As used herein, a therapeutically-effective amount means the amount of a compound (e.g., a nucleic acid molecule) required to achieve a desired result (e.g., induce an immune response against Zika virus). While it is possible for a nucleic acid molecule, proteins, or VLP, of the invention to be administered alone, it is preferable they be administered as a pharmaceutical composition.

Pharmaceutical compositions of the invention may be specially formulated for administration in solid or liquid form, including those adapted for the following: (1) oral administration, for example, drenches (aqueous or non-aqueous solutions or suspensions), tablets, e.g., those targeted for buccal, sublingual, and systemic absorption, boluses, powders, granules, pastes for application to the tongue; (2) parenteral administration, for example, by subcutaneous, intramuscular, intravenous or epidural injection as, for example, a sterile solution or suspension, or sustained-release formulation; (3) topical application, for example, as a cream, ointment, or a controlled-release patch or spray applied to the skin; (4) intravaginally or intrarectally, for example, as a pessary, cream or foam; (5) sublingually; (6) ocularly; (7) transdermally; (8) inhaled into the lungs, for example, by nebulizer or aerosol inhaler; or (9) nasally. Examples of suitable carriers, additives and diluents are described in U.S. Patent Publication No. 2015/0361428, which is incorporated herein by reference in its entirety. One embodiment of the present invention is a method to induce an immune response to Zika virus in individual, the method comprising administering to the individual a nucleic acid molecule of the invention, a protein of the invention, a VLP of the invention, or a therapeutic composition comprising a nucleic acid molecule, a protein, or a VLP, of the invention. One embodiment of the present invention is a method to induce an immune response to Zika virus in an individual, the method comprising:

a) obtaining a nucleic acid molecule of the invention, a protein of the invention, a VLP of the invention, or a therapeutic composition comprising a nucleic acid molecule, a protein, or a VLP, of the invention; and, b) administering to the individual the nucleic acid molecule of the invention, the protein of the invention, the VLP of the invention, or the therapeutic composition comprising the nucleic acid molecule, the protein, or the VLP, of the invention, such that an immune response against Zika virus is produced.

One embodiment of the present invention is a method to vaccinate an individual against Zika virus, the method comprising administering to the individual a nucleic acid molecule of the invention, a protein of the invention, a VLP of the invention, or a therapeutic composition comprising a nucleic acid molecule, a protein, or a VLP, of the invention. One embodiment of the present invention is a method to vaccinate an individual against infection with Zika virus, the method comprising:

a) obtaining a nucleic acid molecule of the invention, a protein of the invention, a VLP of the invention, or a therapeutic composition comprising a nucleic acid molecule, a protein, or a VLP, of the invention; and, b) administering to the individual the nucleic acid molecule of the invention, the protein of the invention, the VLP of the invention, or the therapeutic composition comprising the nucleic acid molecule, the protein, or the VLP, of the invention, such that an immune response against Zika virus is produced.

One embodiment of the present invention is a method to protect an individual against infection by Zika virus, the method comprising administering to the individual a nucleic acid molecule of the invention, a protein of the invention, a VLP of the invention, or a therapeutic composition comprising a nucleic acid molecule, a protein, or a VLP, of the invention. One embodiment of the present invention is a method to protect an individual against infection by Zika virus, the method comprising:

a) obtaining a nucleic acid molecule of the invention, a protein of the invention, a VLP of the invention, or a therapeutic composition comprising a nucleic acid molecule, a protein, or a VLP, of the invention; and, b) administering to the individual the nucleic acid molecule of the invention, the protein of the invention, the VLP of the invention, or the therapeutic composition comprising the nucleic acid molecule, the protein, or the VLP, of the invention, such that a protective immune response against Zika virus is produced.

Vaccines of the present invention can be used to vaccinate individuals using a prime/boost protocol. Such a protocol is described in U.S. Patent Publication No. 20110177122, which is incorporated herein by reference in its entirety. In such a protocol, a first vaccine composition may be administered to the individual (prime) and then after a period of time, a second vaccine composition may be administered to the individual (boost). Administration of the boosting composition is generally weeks or months after administration of the priming composition, preferably about 2-3 weeks or 4 weeks, or 8 weeks, or 16 weeks, or 20 weeks, or 24 weeks, or 28 weeks, or 32 weeks. In one embodiment, the boosting composition is formulated for administration about 1 week, or 2 weeks, or 3 weeks, or 4 weeks, or 5 weeks, or 6 weeks, or 7 weeks, or 8 weeks, or 9 weeks, or 16 weeks, or 20 weeks, or 24 weeks, or 28 weeks, or 32 weeks after administration of the priming composition The first and second vaccine compositions can be, but need not be, the same composition. Thus, in one embodiment of the present invention, the step of administering the vaccine comprises administering a first vaccine composition, and then at a later time, administering a second vaccine composition. In one embodiment, the first vaccine composition comprises a nucleic acid molecule or a VLP of the present invention. In one embodiment, the second vaccine composition can comprise a nucleic acid molecule or a VLP of the invention.

Current diagnostic tests for infection with Zika virus use specific Zika virus proteins or inactivated virus to detect anti-Zika virus antibodies in an individual's blood. However, because VLPs (including RVPs) of the invention have a three-dimensional structure resembling Zika virus, and because such VLPs (and RVPs) are non-infectious, they provide a safer and more accurate reagent for detecting anti-Zika virus antibodies. Thus, one embodiment of the invention is a method of detecting anti-Zika virus antibodies in a sample, comprising:
  a. contacting at least a portion of the sample with a VLP of the invention, under conditions suitable for forming a VLP:antibody complex; and,
  b. detecting the presence of the VLP:antibody complex, if present;
wherein the presence of the VLP:antibody complex indicates the presence of anti-Zika virus antibodies in the sample.

Because assays and methods of the present invention can detect anti-Zika virus antibodies in a sample, including a blood sample, such assays can be used to identify individuals having anti-Zika antibodies. Thus, one embodiment of the present invention is a method to identify an individual having anti-Zika virus antibodies, the method comprising:
  a. contacting a sample from an individual being tested for anti-Zika antibodies with a VLP of the present invention; and,
  b. analyzing the contacted sample for the presence of a VLP:antibody complex wherein the presence of a VLP:antibody complex indicates the individual has anti-influenza antibodies.

One embodiment of the present invention is method to identify an individual that has been exposed to Zika virus, the method comprising:
  a. contacting at least a portion of a sample from an individual being tested for anti-Zika antibodies with a VLP of the present invention;
  b. analyzing the contacted sample for the presence or level of a VLP:antibody complex, wherein the presence or level of VLP:antibody complex indicates the presence or level of recent anti-Zika virus antibodies; and,
  c. comparing the recent anti-Zika virus antibody level with a past anti-Zika virus antibody level;
wherein an increase in the recent anti-Zika virus antibody level over the past anti-Zika virus antibody level indicates the individual has been exposed to Zika virus subsequent to determination of the past anti-Zika virus antibody level.

Methods of the present invention are also useful for determining the response of an individual to a vaccine. Thus, one embodiment is a method for measuring the response of an individual to a Zika virus vaccine, the method comprising:
  a. administering to the individual a vaccine for Zika virus;
  b. contacting at least a portion of a sample from the individual with a VLP of the present invention;
  c. analyzing the contacted sample for the presence or level of a VLP:antibody complex, wherein the presence or level of VLP:antibody complex indicates the presence or level of recent anti-Zika virus antibodies wherein an increase in the level of antibody in the sample over the pre-vaccination level of antibody in the individual indicates the vaccine induced an immune response in the individual.

While not necessary to perform the disclosed method, it may be preferable to wait some period of time between the step of administering the vaccine and the step of determining the level of anti-Zika virus antibody in the individual. In one embodiment, determination of the level of anti-Zika virus antibodies present in the individual is performed at least 1 day, at least 2 days, at least 3 days, at least 4 days, at least 5 days, at least 6 days, at least one week, at least two weeks, at least three weeks, at least four weeks, at least two months, at least three months or at least six months, following administration of the vaccine.

Any assay format can be used to perform these methods. Examples of useful assay formats include, but are not limited to, a radial diffusion assay, an enzyme-linked immunoassay, a competitive enzyme-linked immunoassay, a radioimmunoassay, a fluorescence immunoassay, a chemiluminescent assay, a lateral flow assay, a flow-through assay, a particulate-based assay (e.g., using particulates such as, but not limited to, magnetic particles or plastic polymers, such as latex or polystyrene beads), an immunoprecipitation assay, a BioCoreJ assay (e.g., using colloidal gold), an immunodot assay (e.g., CMG=s Immunodot System, Fribourg, Switzerland), and an immunoblot assay (e.g., a western blot), an phosphorescence assay, a flow-through assay, a chromatography assay, a PAGe-based assay, a surface plasmon resonance assay, a spectrophotometric assay, and an electronic sensory assay.

As previously stated, VLPs of the invention include RVPs. Thus, in the afore-mentioned assays and methods, the VLP can be a RVP. In such embodiments, the RVP can comprise at least one Zika virus structural protein disclosed herein, including modified Zika virus structural proteins disclosed herein. Any Zika virus structural protein disclosed herein can be used to produce the RVP, provided the RVP is capable of binding an anti-Zika virus antibody. Preferred RVPs are also pseudo-infectious RVPs. In methods utilizing RVPs, the presence, absence, or titer, of anti-Zika virus antibodies in a sample can be measured by determining the ability of a test sample to inhibit the entry of RVPs into cells normally permissive for entry of the RVPs. Entry of the RVPs into cells is determined by measuring the expression of the reporter molecule carried by the RVPs, in cells that have been contacted with the RVPs. If a test sample, when contacted with the RVPs prior to contact with the permissive cells, reduces the number of RVPs entering the permissive cells, it can be concluded that the test sample contains anti-Zika virus antibodies. Moreover, by determining the reduction in titer (e.g., percent, log, etc) caused by the sample, the titer of anti-Zika virus antibody can be determined. Methods for determining titers are known to those skilled in the art.

Thus, one embodiment of the invention is a method of detecting anti-Zika virus antibodies in a sample, comprising:
  a. exposing a RVP of the invention to at least a portion of the sample;
  b. contacting the sample-exposed RVP with a cell permissive for entry of the RVP; and,
  c. analyzing the permissive cell for the presence of the reporter molecule encoded by the RVP;
wherein the absence of the reporter molecule in the permissive cell indicates the presence of anti-Zika virus antibodies in the sample.

One embodiment of the invention is a method of detecting anti-Zika virus antibodies in a test sample, comprising:

a. exposing RVPs of the invention to at least a portion of the test sample;
b. contacting the test sample-exposed RVPs with cells permissive for entry of the RVP;
c. analyzing the permissive cells for the presence of the reporter molecule encoded by the RVP, thereby determining the amount of RPVs able to enter the permissive cells; and,
d. comparing the amount of RPVs contacted with the cells with the amount of RVPs able to enter the permissive cells;
wherein an amount of RVPs able to enter the permissive cells that is significantly lower than the amount of RVPs contacted with the permissive cells indicates the presence of anti-Zika virus antibodies in the sample.

In certain embodiments, the amount of RVPs is measured as a titer, which, as used herein, means the number of RVPs (e.g, the number of physical RVP particles) or the concentration of RVPs. As used herein with regard to the amount of RVPs, significantly lower means a difference that is statistically significant, and is greater than the difference observed using a control sample. Methods of determining statistically significant differences are known to those skilled in the art.

In the methods disclosed herein, the methodology used to analyze the permissive cells for the presence of the reporter molecule will depend on the nature of the reporter molecule. For example, if the reporter molecule is an enzyme, the detection method may be an enzymatic assay. In an alternative example, if the reporter molecule is a fluorescent protein, the analysis method may comprise exposing the permissive cells to the appropriate excitation wavelength and measuring the resulting fluorescence.

In certain of the afore-mentioned methods, the amount (titer, concentration, etc.) of RVP particles can be known prior to their contact with the permissive cells, using any methods of determining titers known in the art. In such embodiments, the number of RVPs able to enter permissive cells can (as determined by measuring the presence of the reporter molecule) can be compared to the known titer of the starting RVPs. In certain embodiments, the amount of RVPs contacted with the permissive cells is determined as part of performing the method. For example, in certain embodiments, an aliquot of RVPs is exposed to the test sample while an identical aliquot of RVPs is separately exposed to a control sample. As used herein, a control sample is a sample known to lack anti-Zika virus antibodies. For example, a commonly used control sample is a blood (whole blood, serum, plasma, etc) sample from an individual known to lack antibodies to the agent of interest (e.g., Zika virus). The number of RVPs in each aliquot that are capable of entering permissive cells is then determined by contacting the two aliquots of RVPs with permissive cells, and determining the number of permissive cells comprising the reporter molecule encoded by the RVPs. A comparison can then be made between the number of cells that received the test-sample exposed RVPs and that are reporter molecule positive, and the number of cells that received the control sample-exposed RVPs and that are reporter molecule positive. A finding that the number of cells containing the reporter molecule from the test sample-exposed RVPs is significantly lower than the number of cells containing the reporter molecule from the control sample-exposed RVPs, indicates the presence of anti-Zika virus antibodies in the test sample. A finding that the number of cells containing the reporter molecule from the test sample-exposed RVPs is statistically the same as the number of cells containing the reporter molecule from the control sample-exposed RVPs, indicates the absence of anti-Zika virus antibodies in the test sample. It should be apparent to one skilled in the art that because such methodology can determine the actual number of RVPs being prevented from entering the permissive cells, it can be used to determine the titer of anti-Zika virus antibodies in a sample. Thus, in one embodiment, a disclosed method of the invention is used to determine the titer of antibody in a sample.

In certain embodiments, the RVPs contacted with the test sample, and the RVPs contacted with the control sample comprise nucleic acid molecules encoding different reporter molecules. For example, RVPs contacted with the test sample may comprise a nucleic acid molecule encoding green fluorescent protein, whereas RVPs contacted with the test sample may comprise a nucleic acid molecule encoding yellow fluorescent protein. Such an embodiment allows multiplexing assays in in which the two RVPs samples can be added to the same sample of permissive cells.

One embodiment of the present invention is a method to identify an individual having anti-Zika virus antibodies, the method comprising:
a. contacting a RVP of the invention with at least a portion of a sample from the individual;
b. contacting the sample-exposed RVP with a cell permissive for entry of the RVP; and, c. analyzing the permissive cell for the presence of the reporter molecule encoded by the RVP;
wherein the absence of the reporter molecule in the permissive cell indicates the individual has anti-Zika virus antibodies.

One embodiment of the present invention is a method to identify an individual having anti-Zika virus antibodies, the method comprising:
a. exposing RVPs of the invention to at least a portion of a test sample from the individual;
b. contacting the test sample-exposed RVPs with cells permissive for entry of the RVP;
c. analyzing the permissive cells for the presence of the reporter molecule encoded by the RVP, thereby determining the amount of RPVs able to enter the permissive cells; and,
d. comparing the amount of RPVs contacted with the cells with the amount of RVPs able to enter the permissive cells;
wherein an amount of RVPs able to enter the permissive cells that is significantly lower than the amount of RVPs contacted with the permissive cells indicates the individual has anti-Zika virus antibodies.

One embodiment of the present invention is method to identify an individual that has been exposed to Zika virus, the method comprising:
a. contacting a RVP of the invention with at least a portion of a sample from the individual;
b. contacting the sample-exposed RVP with a cell permissive for entry of the RVP; and,
c. analyzing the permissive cell for the presence of the reporter molecule encoded by the RVP;
wherein the absence of the reporter molecule in the permissive cell indicates the individual has been exposed to Zika virus.

One embodiment of the present invention is method to identify an individual that has been exposed to Zika virus, the method comprising:
a. exposing RVPs of the invention to at least a portion of a test sample from the individual;
b. contacting the test sample-exposed RVPs with cells permissive for entry of the RVP;

c. analyzing the permissive cells for the presence of the reporter molecule encoded by the RVP, thereby determining the amount of RPVs able to enter the permissive cells; and, d. comparing the amount of RPVs contacted with the cells with the amount of RVPs able to enter the permissive cells;

wherein an amount of RVPs able to enter the permissive cells that is significantly lower than the amount of RVPs contacted with the permissive cells indicates the individual has been exposed to Zika virus.

Methods of the present invention are also useful for determining the response of an individual to a vaccine. Thus, one embodiment is a method for measuring the response of an individual to a Zika virus vaccine, the method comprising:

a. administering to the individual a vaccine for Zika virus;

b. contacting a RVP of the invention with at least a portion of a sample from the individual;

c. contacting the sample-exposed RVP with a cell permissive for entry of the RVP; and, d. analyzing the permissive cell for the presence of the reporter molecule encoded by the RVP;

wherein the absence of the reporter molecule in the permissive cell indicates the presence or level of recent anti-Zika virus antibodies.

One embodiment is a method for measuring the response of an individual to a Zika virus vaccine, the method comprising:

a. administering to the individual a vaccine for Zika virus;

b. exposing RVPs of the invention to at least a portion of a test sample from the individual;

c. contacting the test sample-exposed RVPs with cells permissive for entry of the RVP;

d. analyzing the permissive cells for the presence of the reporter molecule encoded by the RVP, thereby determining the amount of RPVs able to enter the permissive cells; and, e. comparing the amount of RPVs contacted with the cells with the amount of RVPs able to enter the permissive cells;

wherein an amount of RVPs able to enter the permissive cells that is significantly lower than the amount of RVPs contacted with the permissive cells indicates the presence or level of recent anti-Zika virus antibodies; or wherein an amount of RVPs able to enter the permissive cells that is significantly lower than the amount of RVPs contacted with the permissive cells indicates the vaccine induced an immune response in the individual.

While not necessary to perform the disclosed method, it may be preferable to wait some period of time between the step of administering the vaccine and the step of determining the level of anti-Zika virus antibody in the individual. In one embodiment, determination of the level of anti-Zika virus antibodies present in the individual is performed at least 1 day, at least 2 days, at least 3 days, at least 4 days, at least 5 days, at least 6 days, at least one week, at least two weeks, at least three weeks, at least four weeks, at least two months, at least three months or at least six months, following administration of the vaccine.

Also included in this disclosure are kits useful for practicing the disclosed methods. A kit may include nucleic acid molecules, proteins, VLPs or RVPs of the invention. These kits may also contain at least some of the reagents required to produce such nucleic acid molecules, proteins, VLPs and/or RVPs. Such reagents may include, but are not limited to, isolated nucleic acid molecules, such as expression vectors, primers, sets of primers, or an array of primers.

The kit may also comprise instructions for using the kit, and various reagents, such as buffers, necessary to practice the methods of the invention. These reagents or buffers may be useful for administering nucleic acid molecules or VLPs of the invention to a cell or an individual. The kit may also comprise any material necessary to practice the methods of the invention, such as syringes, tubes, swabs, and the like.

EXAMPLES

Example 1. Development of a Zika Virus Vaccine

This Example demonstrates that a defined threshold of DNA vaccine-induced Zika virus-neutralizing antibodies protects rhesus macaques from viremia following challenge.

Zika virus (ZIKV) was identified as a cause of congenital disease during an explosive outbreak in the Americas and Caribbean in 2015. Because of the ongoing fetal risk from endemic disease and travel-related exposures, a vaccine to prevent viremia in women of child-bearing age and their partners is imperative. Vaccination experiments conducted with DNA expressing the prM and E proteins of ZIKV was immunogenic in mice and nonhuman primates, and protection against viremia after ZIKV challenge correlated with serum neutralizing activity. These data not only suggest DNA vaccination could be a successful approach to protect against ZIKV infection, but also establish a protective threshold of neutralizing activity that will prevent viremia following acute infection. Application of these approaches to vaccination and serological evaluation have been advanced into clinical studies to establish a similar protective threshold of immunity in humans.

The emergence of Zika virus (ZIKV) in the Americas and the Caribbean follows a series of global threats to public health from mosquito-borne viral diseases over the last three decades. ZIKV was discovered in Africa in 1947 where it circulated widely for decades without causing significant or frequent disease in humans. ZIKV was associated with a relatively mild febrile dengue-like illness with rash and arthralgia (1). Outbreaks characterized by a high attack rate in the Yap islands in 2007 (2), French Polynesia in 2013 (3), then Brazil in 2015 (4) revealed the epidemic potential of ZIKV and an association between infection of pregnant women and neurodevelopmental defects of the infected fetus (5) reminiscent of congenital rubella syndrome. Because of the profound impact on individuals and society as a whole from a disabling congenital disease, WHO declared ZIKV infection a global health emergency in February 2016. Although it is likely that the incidence of ZIKV infection will decline significantly within 1-2 years (6), it is also likely to become endemic in tropical and subtropical regions with sporadic outbreaks and potential for spread into new geographical areas, as observed with other emerging arboviruses like West Nile (WNV) and chikungunya viruses. Therefore, unless immunity is established before childbearing age, pregnant women will continue to be at risk for an infection that could harm their fetus. Further, because men can harbor ZIKV in semen for several months following a clinically inapparent infection and can sexually transmit virus to a pregnant partner (7), even women in nonendemic regions will have some ongoing risk if exposed to men who have traveled to endemic regions. These unique features of transmission and disease suggest there will be an ongoing need for a ZIKV vaccine to maintain a high level of immunity in the general population and in travelers to endemic regions to reduce the frequency of fetal infection.

Licensed flavivirus vaccines against yellow fever (YF), tick-borne encephalitis (TBE), Japanese encephalitis (JEV), and dengue (DENV) viruses have been developed using multiple platforms including whole-inactivated and live-attenuated viruses (8-11). While these approaches are likely to be effective for ZIKV (12), the development process traditionally takes many years. To rapidly address the critical need for a preventive vaccine to curtail the current Zika outbreak in the Americas, we chose a gene-based vaccine delivery approach that leverages our prior experience with a DNA-based WNV vaccine (13). Advantages of DNA vaccines include the ability to rapidly test multiple candidate antigen designs, rapidly produce GMP material, an established safety profile in humans, and a relatively straightforward regulatory pathway into clinical evaluation. An important aspect of the current ZIKV DNA vaccine development process is that rapid evaluation of intervention approaches provides the opportunity to define efficacy in the setting of natural transmission and to establish a correlation of protection that might be applied to other interventions to facilitate licensure.

Antigen Design. Antigen design was guided by prior knowledge about humoral immunity to flaviviruses. Neutralizing antibodies (NAb) are a critical component of protection from disease, and vaccine elicited-neutralizing activity is associated with protection from most flaviviruses (14). The primary target of NAbs is the envelope (E) protein arrayed on the surface of the virus particle. Because the most potent monoclonal NAbs map to conformational epitopes in domain III (DIII) of the E protein (15), or more complex quaternary epitopes that bridge between antiparallel E dimers or between dimer rafts (16, 17), our goal was to identify constructs that produced antigens that most faithfully capture the antigenic complexity of infectious virions. Expression of the structural proteins premembrane (prM) and E have been shown sufficient for the production and release of virus-like subviral particles (SVPs) with antigenic and functional properties similar to those of infectious virions (18, 19).

To identify promising vaccine candidates, prM-E constructs were synthesized and screened for expression and efficiency of particle release from transfected cells. DNA vector constructs. ZIKV DNA vaccine plasmid VRC5283 was based on the H/PF/2013 French Polynesian virus isolate (GenBank accession AHZ13508.1). The plasmid encodes the ZIKV structural proteins prM and E under the control of the CMV immediate early promoter for expression in mammalian cells. The insert was synthesized by GenScript (Piscataway, N.J.) using human codon-optimized ZIKV virus sequence and the Japanese encephalitis virus (JEV) signal sequence published previously for a WNV DNA vaccine (23). The JEV signal sequence is derived from JEV-GKP/0944234 (GenBank #ADZ48450.1) and is followed by the ZIKV prM-E genes. Another DNA vaccine, VRC5288, is based on VRC 5283 with the last 98 amino acids (stem and transmembrane regions) of E protein swapped with the last 98 amino acids of E protein of JEV (GenBank #BAA14218.1). The inserts were cloned into the mammalian expression vector VRC8400 (13, 20, 21). VRC4974 is identical to VRC5283 with the exception of a three amino acid deletion at the amino terminus of prM that prevents SVP release. VRC8111 is a previously described WNV DNA vaccine used here as another control, and was described before (13, 34). VRC3593 is a vaccine candidate for the Middle East respiratory syndrome coronavirus (MERS-CoV) (26).

Cell lines and viruses. Mammalian cells were maintained at 37° C. in the presence of 7% $CO_2$. HEK-293T and Vero cells were grown in Dulbecco's Modified Eagle medium (DMEM) containing Glutamax and supplemented with 7% fetal bovine serum (FBS) and 100 U/mL penicillin-streptomycin (PS) (Invitrogen). Raji cells stably expressing DC-SIGNR (Raji-DCSIGNR) were cultured in RPMI-1640 medium supplemented with 7% FBS and 100 U/ml PS (32). Freestyle 293-F cells (Invitrogen) were grown in Freestyle 293 Expression medium supplemented with 7% FBS and 100 U/ml PS and maintained at 37° C. in the presence of 8% $CO_2$ according to the manufacturer's instructions. ZIKV strain H/PF/2013 collected during the 2013 French Polynesian outbreak (33) was used for FRNT neutralization assays (described in greater detail below). Stocks of ZIKV were produced by infecting pre-plated Vero cells and collecting supernatant on days 2-4. Virus was clarified, passed through a 0.2 μM membrane filter, and stored in aliquots at −80° C. until use. The Puerto Rican ZIKV strain PRVABC59 (30) was used in MN assays.

prM-E sequences were inserted into a CMV-immediate early promoter containing vector (VRC8400) that has been evaluated clinically in several prior studies (13, 20, 21).

The prM-E sequence in these constructs was selected from a French Polynesian isolate (ZIKV strain H/PF/2013, GenBank: AHZ13508.1) that is identical or highly related to strains circulating in the Americas. Neutralization studies with contemporary sera and multiple ZIKV strains indicate ZIKV exists as a single serotype, suggesting a vaccine antigen is expected to provide protection against all ZIKV strains (22). To improve expression, the ZIKV prM signal sequence was exchanged with the analogous region of JEV, as previously reported (23), to create vector VRC5283 (FIG. 1A). A second chimeric ZIKV/JEV prM-E construct, VRC5288, also encoding the JEV signal sequence, was designed in which the final 98 amino acids of E, that comprise the stem and transmembrane regions (ST/TM), were swapped with the corresponding JEV sequence, which has previously been shown to improve SVP secretion (24).

Western Blotting. HEK-293T cells were transiently transfected with plasmid DNA using Fugene 6 (Promega, WI, USA). Culture supernatant was collected, and cells were rinsed with PBS, pH7.4 and lysed by M-PER Mammalian Protein Extraction Reagent (ThermoFisher, MA, USA) at two to three days post-transfection. SVP precipitate (SVP ppt) was pelleted through a 20% sucrose cushion at 32,000 rpm in a TH-641 rotor (ThermoFisher, MA, USA) for 4 hours at 4° C. and removed from the tube. The pellet was dissolved in THE buffer (50 mM Tris, 140 mM NaCl, 5 mM EDTA, pH 7.4). The total protein content of partially purified SVP and cell lysate was quantitated by BCA method. A mass of SVP ppt (0.5 μg) and cell lysate (25 μg) was mixed with NuPAGE LDS sample buffer (ThermoFisher, MA, USA) and run on NuPAGE Novex 4-12% Bis-Tris Protein Gel (ThermoFisher, MA, USA). Protein was transferred to a PVDF membrane by Trans-Blot Turbo Transfer System (Bio-Rad, CA, USA). Membranes were blocked for 1 h at RT in blocking buffer (5% skim milk (BD Difco, NJ, USA)+2% BSA (Fisher, MD, USA) in PBS, pH7.4 with 0.05% Tween 20 (PBST)) then incubated for 1 h at RT with a 1:1000 dilution of VRC5283-immunized mouse serum in dilution buffer, and washed three times with PB ST. Membranes were incubated for 1 h at RT with horseradish peroxidase (HRP) conjugated goat anti-mouse IgG, Fcγ- specific (Jackson ImmunoResearch, PA, USA) in dilution buffer and washed three times with PBST. The membrane was developed by SuperSignal West Pico Chemiluminescent Substrate (ThermoFisher, MA, USA), and the images were taken by ChemiDoc MP System (Bio-Rad, NJ, USA).

Antigen-capture ELISA (Ag-ELISA). ZIKV SVPs were captured in a particle capture ELISA format using two previously described fusion loop-specific pan anti-flavivirus monoclonal antibodies (mAbs). 96 well Nunc MaxiSorp plate were coated with 1 μg/mL of 6b6c-1 mAb (GeneTex, CA, USA) in carbonate-bicarbonate buffer, pH9.6 (Sigma, MO, USA) was added to 96 well Nunc MaxiSorp plate, and the plates were incubated at 4° C. overnight. The plates were then blocked at 37° C. for 1 h with PBS, pH7.4 in 5% skim milk with 2% BSA (blocking buffer). Serial dilutions of culture supernatant in dilution buffer (blocking buffer with 0.05% Tween 20) were added to the plates, and the plates were incubated at 37° C. for 1 h. Biotinylated 4G2 mAb (5 μg/mL) (ATCC HB-112, VA, USA) was added to the plates, incubated at 37° C. for 1 h and washed with PBST. HRP-conjugated streptavidin (ThermoFisher, MA, USA) was added to the plates, incubated at 37° C. for 30 min and washed with PBST. The assay was developed using 3,3',5', 5-Tetramethylbenzidine HRP substrate (TMB) (KPL, MD, USA), stopped by the addition of 0.5 M $H_2SO_4$ and then measured at 450 nm (SpectraMax Plus384, Molecular Devices, CA, USA).

Particle-based anti-ZIKV antibody ELISA. Partially purified ZIKV SVP (2 μg/mL) were added to 96 well Nunc MaxiSorp plates and incubated at 4° C. overnight. Serial dilutions of sera from ZIKV DNA vaccine-immunized animals in dilution buffer were added to the plates, and incubated at RT for 1 h. HRP conjugated goat anti-mouse IgG, Fcγ-specific (Jackson ImmunoResearch Laboratories) or HRP conjugated goat anti-monkey IgG, Fc-specific (Nordic MUbio, Susteren, The Netherlands) was added to the plates, and the plates were incubated at RT for 1 h and washed with PBST. The ELISA was developed and measured as described above.

Figure 1B:
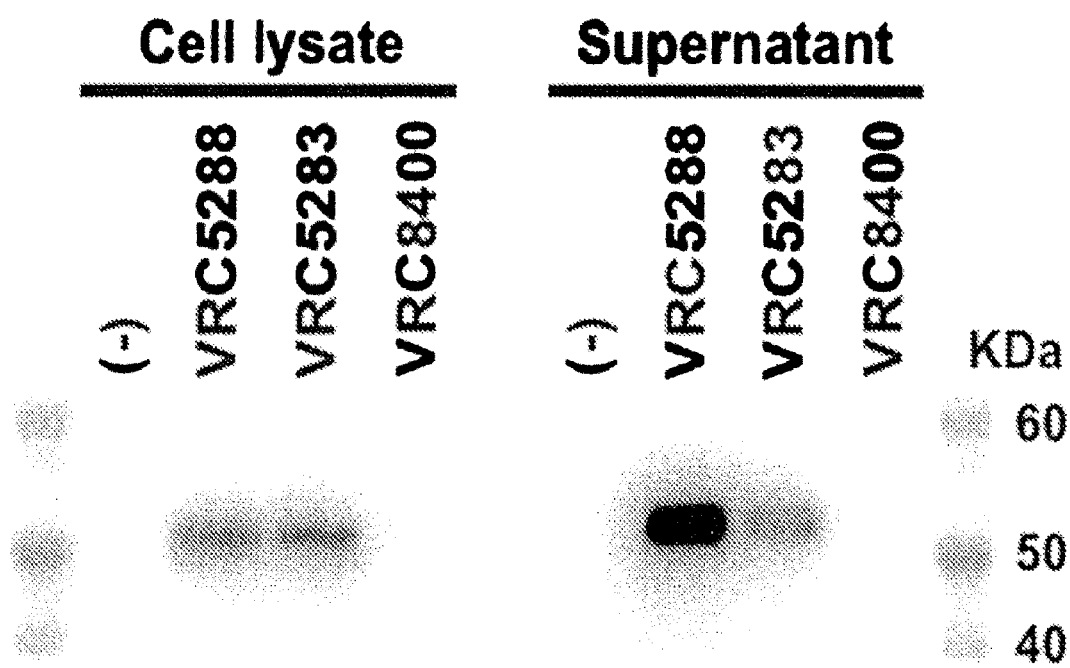
Figure 1C:
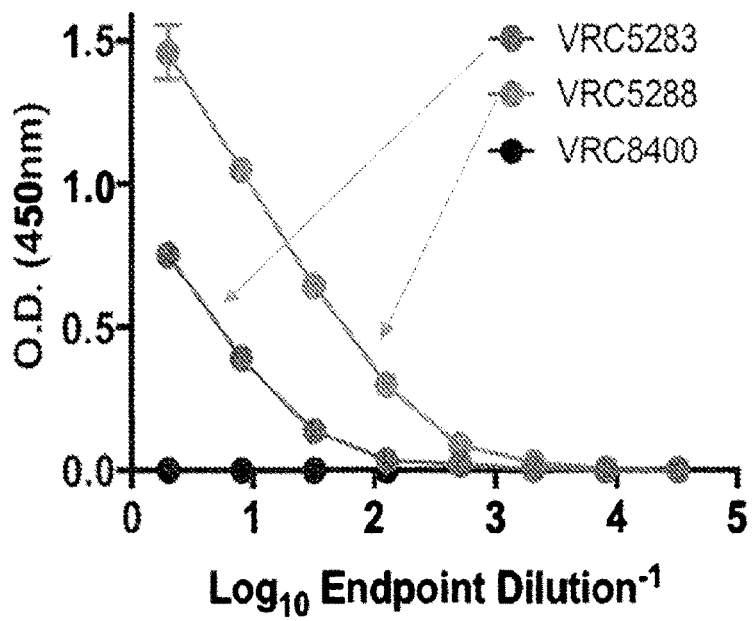
Figure 1D:
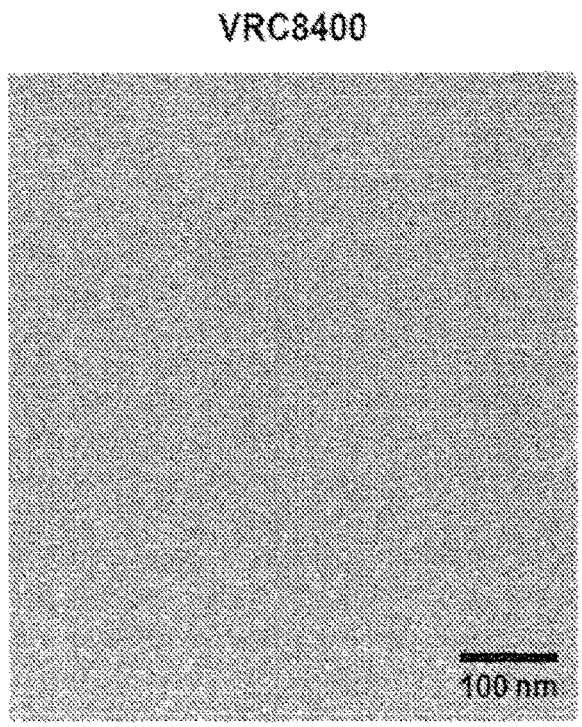
Figure 1D:
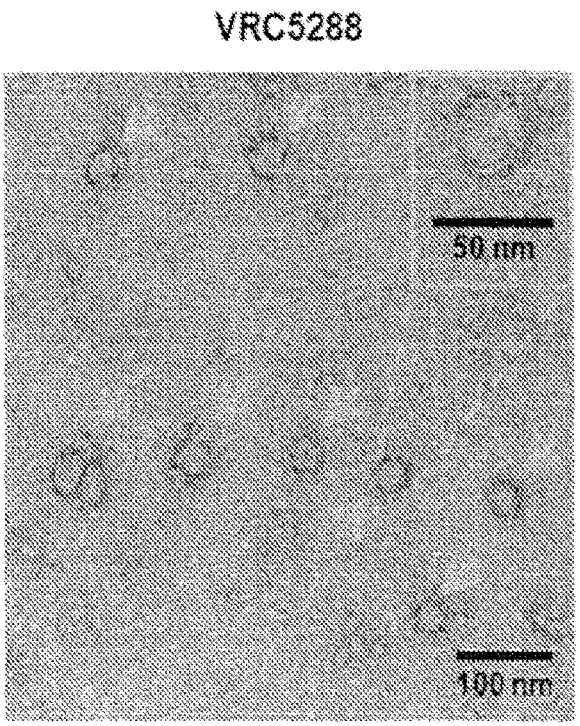
Figure 2A:
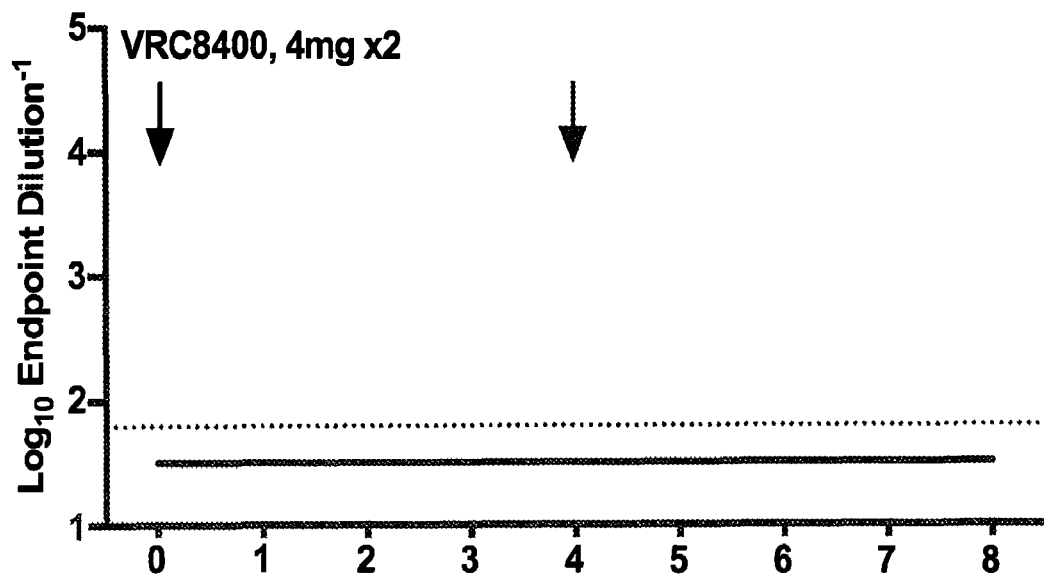
Figure 2B:
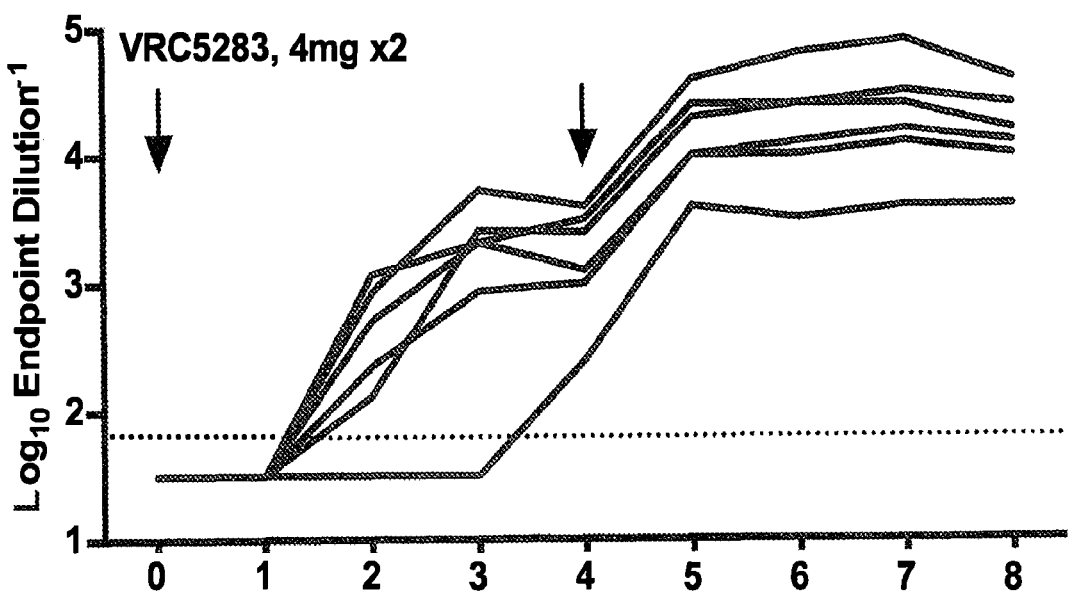
Figure 2C:
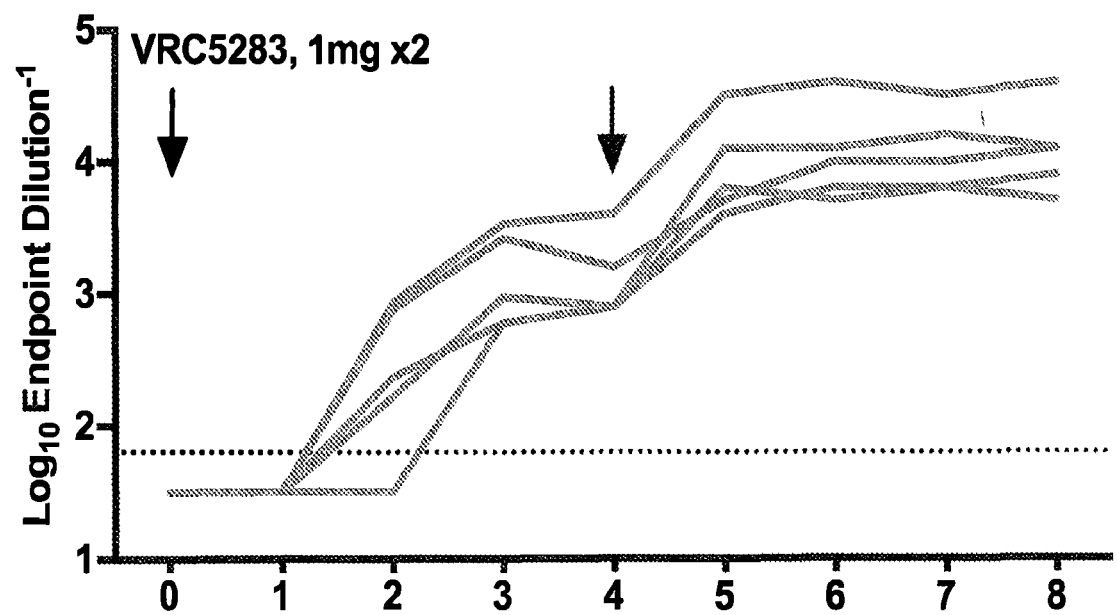
Figure 2D:
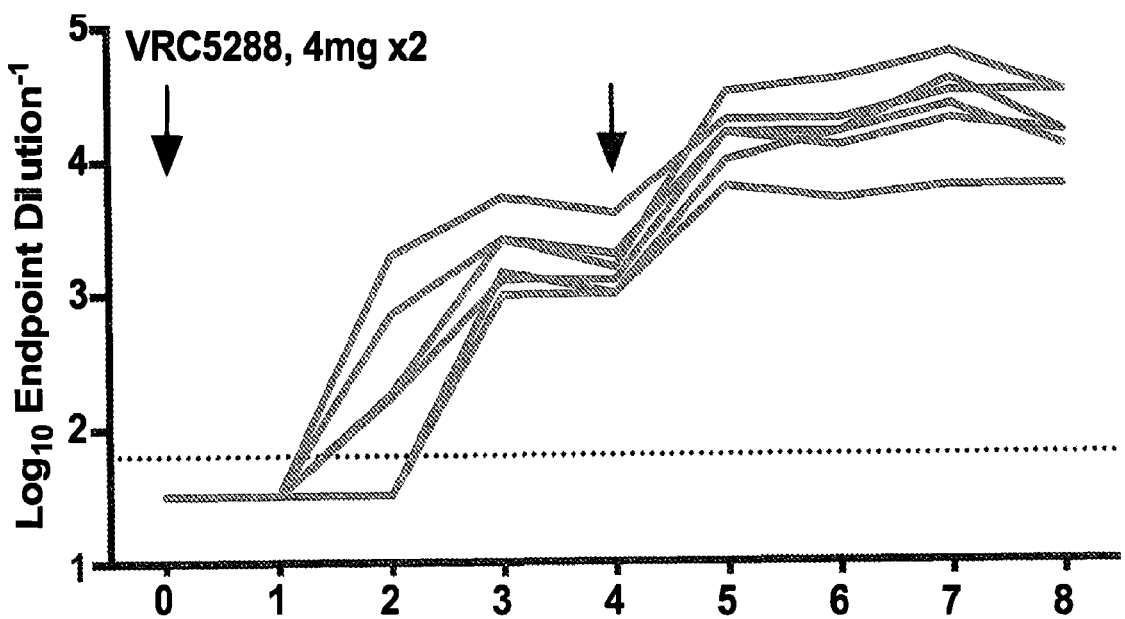
Figure 2E:
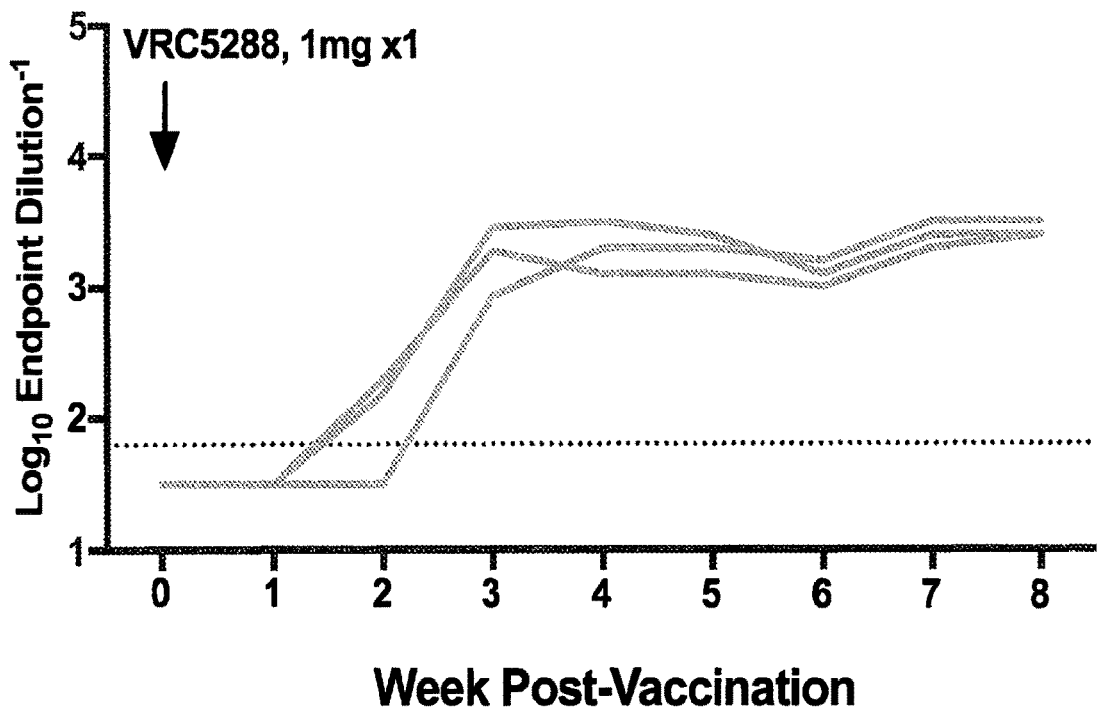
Figure 2F:
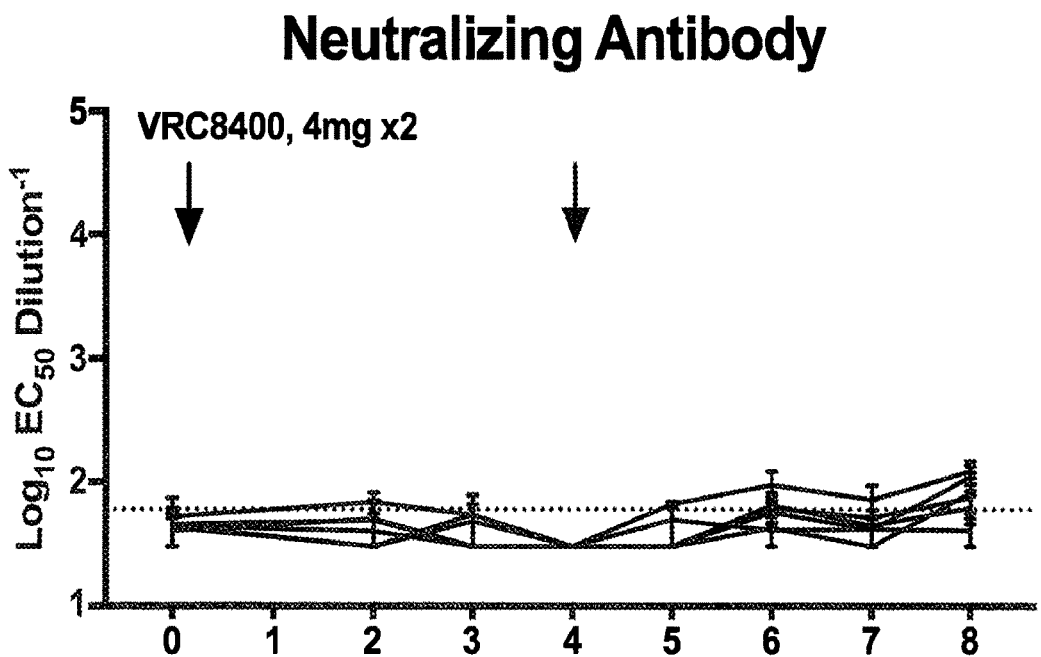
Figure 2G:
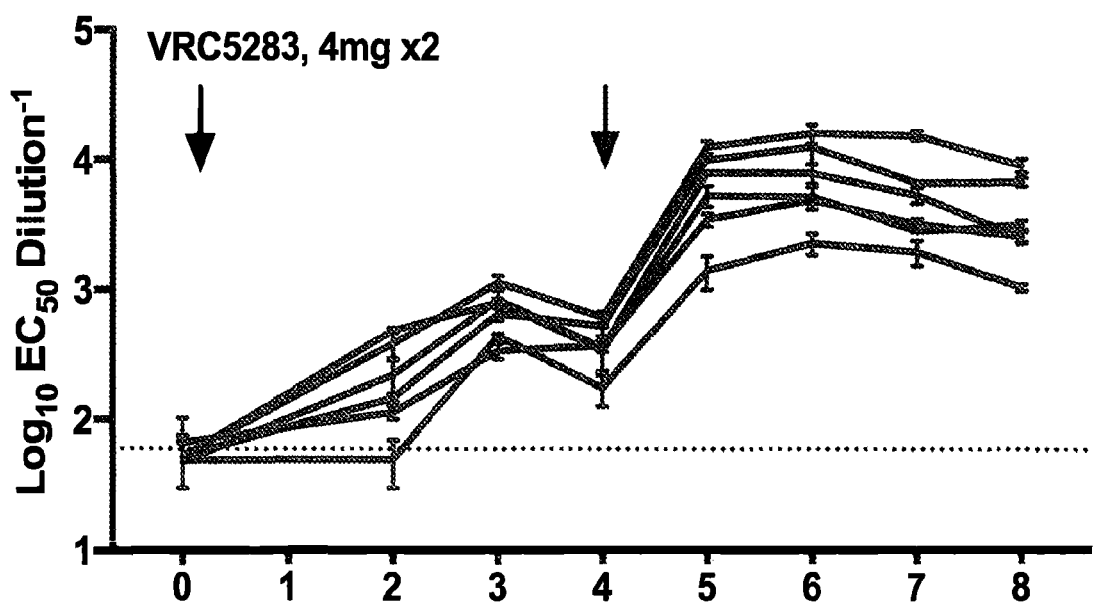
Figure 2H:
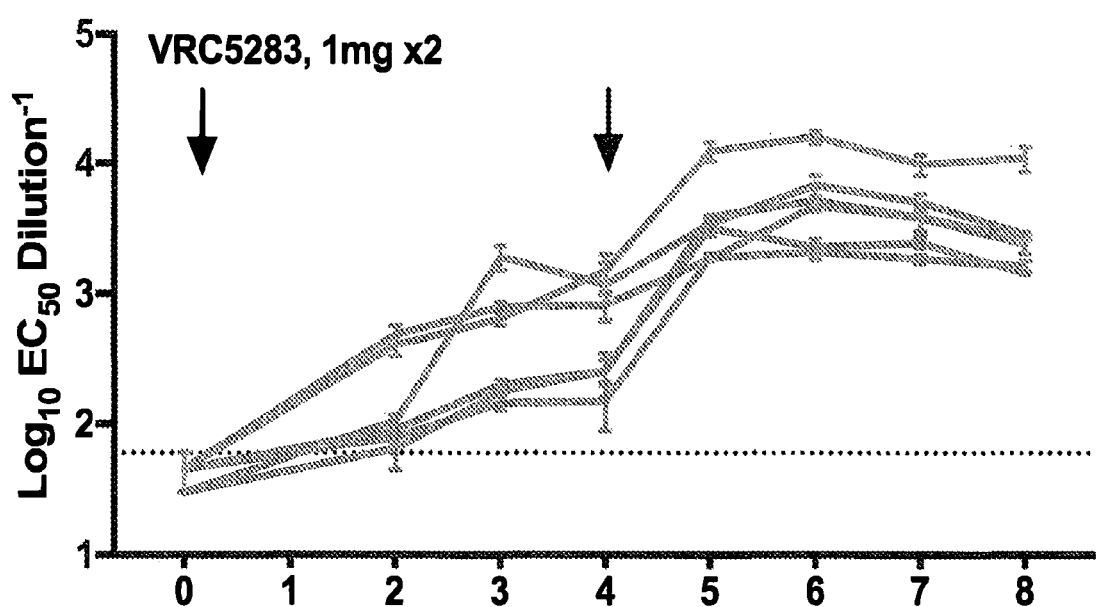
Figure 2I:
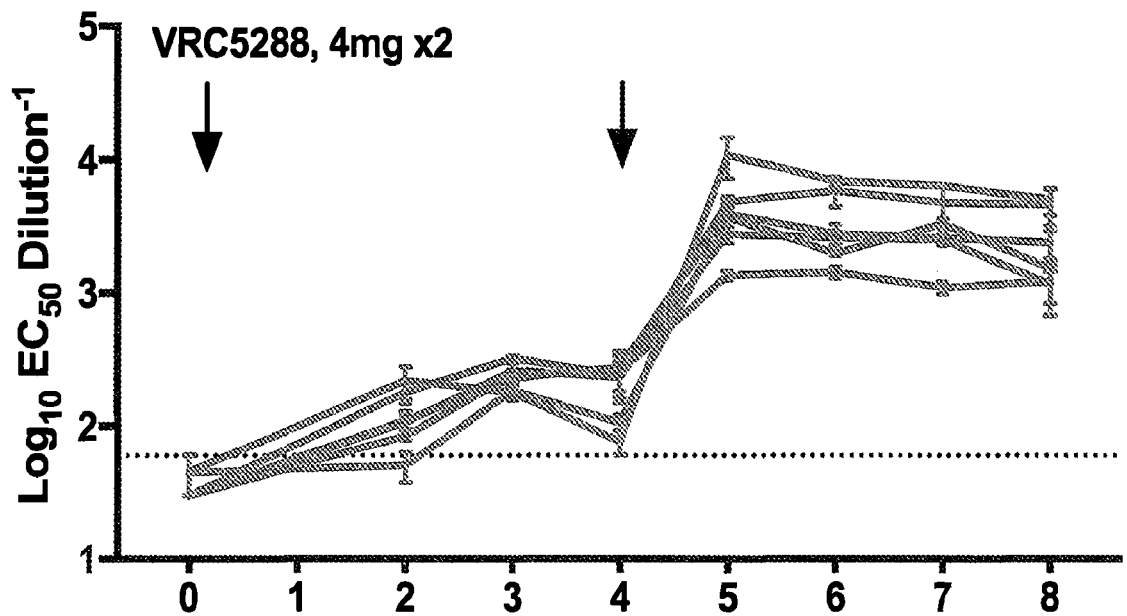
Figure 2J:
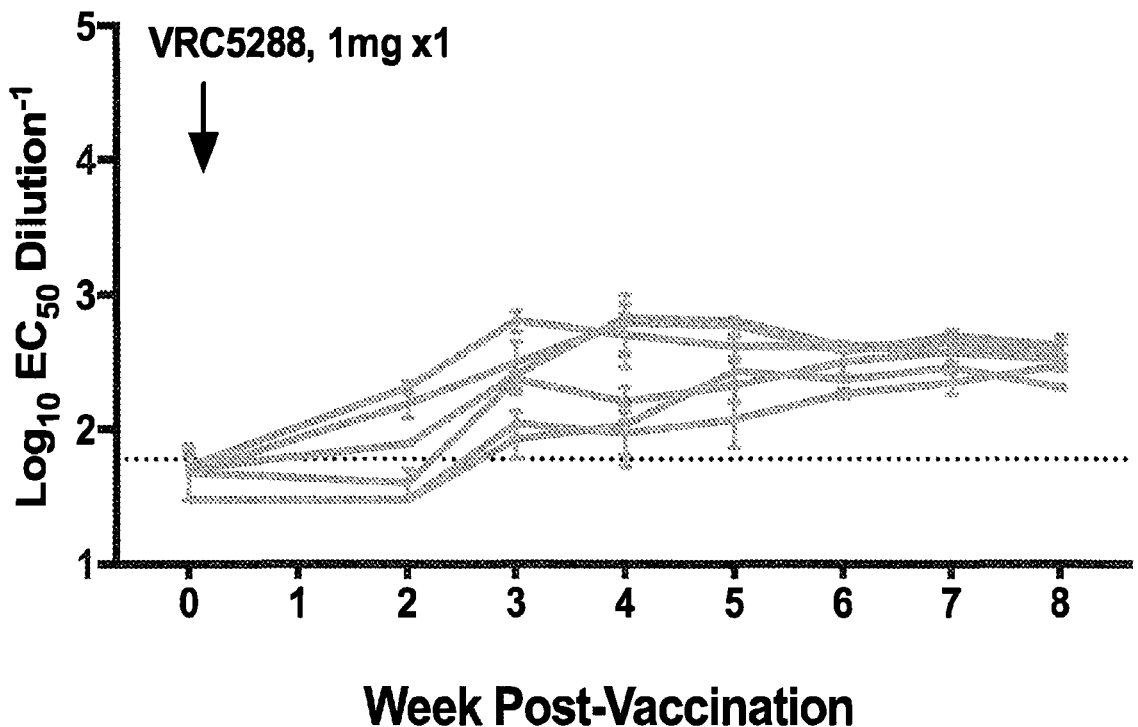
Figure 2K:
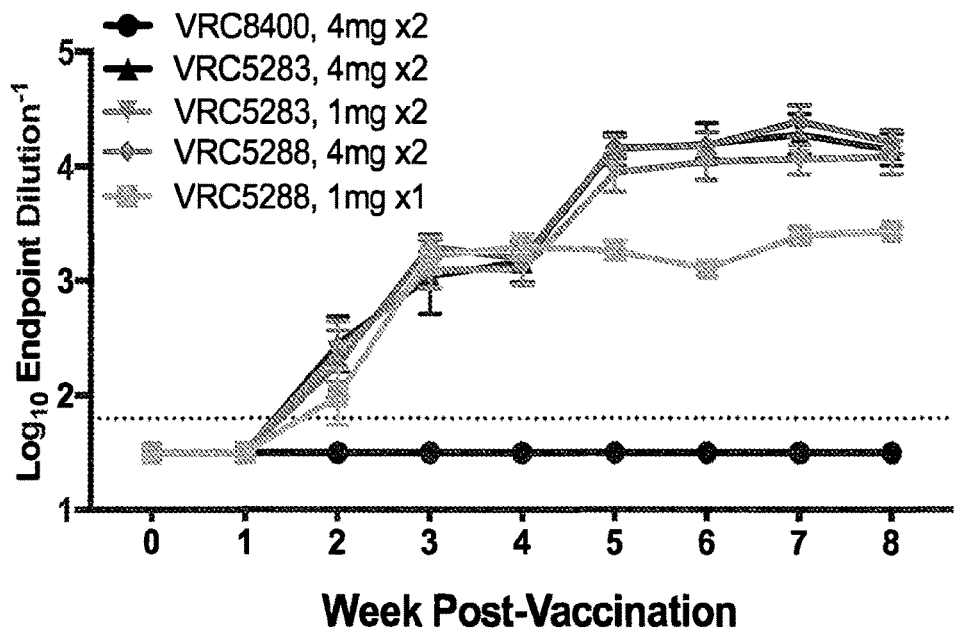
Figure 2L:
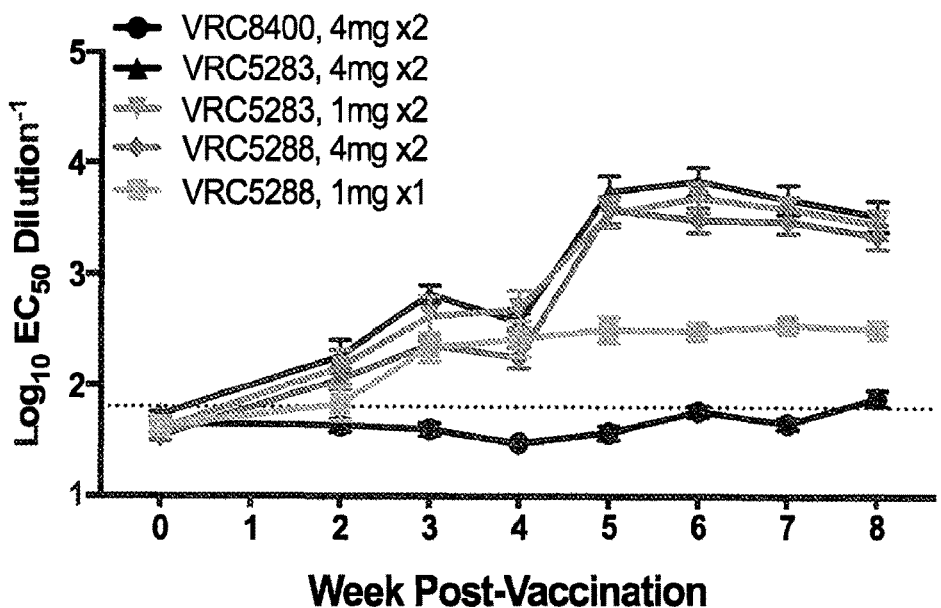

These transient transfection studies revealed that both vectors resulted in expression by mammalian cells (FIG. 1B, right panel), with more efficient SVP release into the supernatant for VRC5288, as measured by Western blots of virus supernatants partially purified through a 20% sucrose cushion (FIG. 1B, right panel), and a particle-capture ELISA (FIG. 1C).

Negative-stain electron microscopy. The Electron Microscopy Laboratory at the National Cancer Institute examined the morphology of the SVPs. Freestyle 293-F cells were transiently transfected with plasmid DNA and supernatant was harvested three days later. SVP were purified from the supernatant by Ion Exchange Chromatography and Multimodal Chromatography. Purified SVPs were fixed by mixing with an equal volume of fixative containing 4% formaldehyde in 100 mM Na-cacodylate buffer, pH 7.4. Samples were adsorbed to freshly glow-discharged carbon-film grids, washed with several drops of buffer containing 10 mM HEPES, pH 7.0, and 150 mM NaCl, and stained with 0.75% uranyl formate. Images were collected using an FEI Tecnai T20 electron microscope operated at 200 kV and equipped with a 2k×2k Eagle CCD camera.

The electron microscopic analysis of negative stained purified VRC5288 SVP preparations revealed roughly spherical particles consistent with the appearance of other flavivirus SVPs (FIG. 1D) (18, 25).

The immunogenicity of each DNA candidate was then assessed in BALB/c and C57BL/6 mice.

Vaccination of mice. C57BL/6 and BALB/c mice were obtained from Jackson Laboratories. Animals were chosen and randomized based on age. 8-12 week old C57BL/6 or BALB/c mice were immunized intramuscularly (IM) by electroporation (BTX AgilePulse, Holliston, Mass.) with 50 μg of plasmid DNA at week 0. Sera was collected weekly and binding antibody responses were analyzed by ELISA and NAb responses were analyzed by RVP neutralization assay.

Reporter virus particle (RVP) production. RVPs are pseudo-infectious virions capable of a single round of infection that are produced by complementation of a GFP-expressing WNV sub-genomic replicon (35) with a plasmid encoding the viral structural proteins (C-prM-E). RVPs incorporating the structural proteins of WNV (35, 36), DENV (37-39), and recently ZIKV (22) have been described. In the current study, WNV NY99 and ZIKV H/PF/2013 RVPs were produced by co-transfection of 293T cells with the replicon and corresponding structural gene plasmid. Transfected cells were incubated at 30° C. and virus-containing supernatants were harvested on days 3-6. Stocks were passed through a 0.2 μM filter and stored in aliquots at −80° C. until use.

RVP neutralization assay. ZIKV RVP neutralization assays were performed as recently described (22). Previously titered RVPs were sufficiently diluted to ensure antibody excess at informative points on the dose-response curves and incubated with serial dilutions of mouse or macaque sera for 1 h at 37° C. to allow for steady-state binding. Antibody-RVP complexes were then used to infect Raji-DCSIGNR cells in duplicate technical replicates. Infections were carried out at 37° C. and GFP-positive infected cells detected by flow cytometry 24-48 h later. Neutralization results were analyzed by non-linear regression to estimate the dilution of sera required for half-maximal neutralization of infection ($EC_{50}$ titer) (Prism 6 software; GraphPad). The initial dilution of sera (1:60, based on the final volume of RVPs, cells, and sera) was set as the limit of confidence of the assay. Neutralization titers predicted by non-linear regression as <60 were reported as a titer of 30 (half the limit of confidence).

The mice were immunized intramuscularly once with 50 μg of DNA in the quadriceps using electroporation as previously described (26). Serum was evaluated for binding to ZIKV SVPs (FIG. 5A) and neutralizing activity using ZIKV reporter virus particles (RVP) (FIGS. 5B-5D) (22).

Vaccination with either VRC5283 or VRC5288 elicited ZIKV-specific NAbs after a single immunization with titers up to $10^5$ reciprocal $EC_{50}$ serum dilution in C57BL/6 mice (FIG. 5D). NAb titers were similar in mice vaccinated with 2, 10, or 50 μg DNA (FIG. 6), and were of similar magnitude to the level observed with a previously described WNV DNA vaccine (FIG. 7) (13).

Vaccination and Challenge of nonhuman primates. Rhesus macaques (*Macaca mulatta*) were used in the nonhuman primate study. Macaques were housed and all experiments performed at Bioqual, Inc. (Rockville, Md.). Animals were chosen and randomized based on age and weight. Rhesus macaques (6/group) were randomized by body weight and administered 4 mg or 1 mg of VRC8400, VRC5283 or VRC5288 IM using PharmaJet (Golden, Colo.) at week 0 and 4 (FIG. 2). Blood was collected weekly for analysis of antibody responses by ELISA and RVP neutralization assay. The immunized animals were challenged SC with a dose of $10^3$ FFU at week 8 and blood samples were collected for determination of viral load.

All data was graphed and statistics performed on $\log_{10}$ transformed data. Neutralizing antibody responses from weeks 0-8 were summarized by the area under the curve, on a logarithmic scale. Differences between the groups were determined using a Kruskal-Wallis test to compare all five groups; since this was significant (p<0.0001) pairwise comparisons were made using Wilcoxon Rank Sum tests. P-values presented have been adjusted for multiple comparisons using Holm's procedure. For viral load comparisons, viral loads trajectories were summarized by area under the curve on a logarithmic scale and significance determined by a Wilcoxon Exact Test. Immunogenicity in rhesus macaques was evaluated after vaccine doses were delivered intramuscularly by a needle-free injection device (PharmaJet) (FIGS. 2, 8, and 9). Six animals per group received two 1 mg (VRC5283) or 4 mg (VRC5283 and VRC5288) doses of vaccine at 0 and 4 weeks, while one group received a single 1 mg dose of VRC5288 at week 0. After a single dose of DNA, binding and neutralizing antibody were detectable by week two and peaked at week three. All ZIKV vaccine groups had significantly higher NAb responses than macaques that received VRC8400 control vector when comparing area under the curve (AUC) using a Kruskal-Wallis test (p=0.022, FIG. 2D).

The macaques that received a single 1 mg dose of VRC5288 had significantly lower NAb titers than macaques that received two doses of either vaccine at either dose level (p=0.022). There were no significant differences in NAb titer between animals that received two doses of VRC5283 or animals that received two doses of VRC5288 by AUC comparison.

FRNT neutralization assay. Neutralizing activity of macaque sera was assessed using a focus reduction neutralization test (FRNT) as recently described for ZIKV (28). Serial dilutions of sera were incubated with 100 FFU of ZIKV H/PF/2013 for 1 h at 37° C. Antibody-virus complexes were added to pre-plated Vero cell monolayers in 96-well plates. After 4 h, cells were overlaid with 1% (w/v) methylcellulose in Opti-MEM medium (Invitrogen) supplemented with 2% FBS and 1×PS. Plates were fixed 40 h later with 1% PFA in PBS. Wells were incubated sequentially with 500 ng/mL of the pan-flavivirus mAb E60 and HRP-conjugated goat anti-mouse IgG in PBS supplemented with 0.1% saponin and 0.1% BSA. ZIKV-infected foci were visualized by TrueBlue peroxidase substrate (KPL) and quantitated on an ImmunoSpot macroanalyzer (Cellular Technologies). Neutralization results were analyzed as described for the RVP neutralization assay to estimate the $EC_{50}$ titer. The initial dilution of sera (1:60, based on the final volume of virus, cells, and sera) was set as the limit of confidence of the assay. Neutralization titers predicted by non-linear regression as <60 were reported as a titer of 30 (half the limit of confidence).

Microneutralization assay. Neutralizing activity of macaque sera was assessed using a previously described ZIKV microneutralization (MN) assay (12, 30). Serial dilutions of macaque sera were incubated with 100 PFU of ZIKV PRVABC59 at 35° C. for 2 h. Antibody-virus complexes were added to pre-plated Vero cell monolayers in 96-well plates and incubated for 4 days. Fixed cells were stained with a flavivirus-reactive antibody conjugated to HRP and developed by the addition of TMB substrate and measurement of the absorbance at 450 nm. Absorbance data was analyzed by linear regression to calculate the $MN_{50}$ titer. Seropositivity was defined as a titer of ≥10.

Sera collected at week 6 were also evaluated for NAb activity by the conventional focus-reduction neutralization test (FRNT) (27, 28) and a microneutralization (MN) assay (12, 29, 30).

The results of both assays strongly correlated with the $EC_{50}$ RVP values (FIG. 10, Table 4), although the RVP assay was more sensitive as demonstrated by a capacity to detect neutralization activity in macaques that received only a single 1 mg dose of VRC5288 as compared to the MN results (average week 6 $EC_{50}$ reciprocal serum NAb titers of 322 versus<10 for RVP and MN assays, respectively). Further comparison of these values suggested that the MN values corresponded more closely to the $EC_{90}$ RVP values (2-fold versus 13.4-fold average difference in RVP $EC_{90}$/MN $EC_{50}$ and RVP $EC_{50}$/MN $EC_{50}$ NAb titers, respectively, for all animals at week 6). These data indicate that both VRC5283 and VRC5288 elicit substantial ZIKV-specific NAb in macaques.

TABLE 4

Comparison of the $EC_{50}$ neutralization titers of nonhuman primate sera collected 6-weeks post-vaccination determined by three distinct assays.

| Group | NHP ID | RVP50 AVE (N-2-4) | STDEV | MN50 N = 1 | FRNT50 AVE (N = 1-4) | STDEV |
|---|---|---|---|---|---|---|
| VRC8400 | A8V016 | 62 | 28 | <10 | nd | — |
| 4 mg × 2 | A6V057 | 42 | 22 | <10 | nd | — |
| | A13V020 | 57 | 26 | <10 | nd | — |
| | A13V091 | 41 | 19 | <10 | nd | — |
| | 13412 | 95 | 54 | <10 | nd | — |
| | 12012 | 65 | 31 | <10 | nd | — |
| VRC5283 | A13V132 | 16302 | 4036 | 4455 | 4799 | 963 |
| 4 mg × 2 | A13V137 | 7994 | 1896 | 517 | 966 | 424 |
| | FLH | 2319 | 752 | 180 | 415 | 146 |
| | A13V064 | 12723 | 4784 | 1489 | 1750 | 499 |
| | 9012 | 5251 | 1459 | 634 | 846 | 293 |
| | 35811 | 4980 | 465 | 691 | 696 | 309 |
| VRC5283 | A13V197 | 5184 | 406 | 380 | nd | — |
| 1 mg × 2 | A13V190 | 6827 | 2150 | 877 | nd | — |
| | 05D216 | 2274 | 650 | 112 | nd | — |
| | A13V047 | 2104 | 416 | 522 | nd | — |
| | 28812 | 16100 | 3068 | 4824 | nd | — |
| | 7711 | 4762 | 651 | 418 | nd | — |
| VRC5288 | A13V066 | 6881 | 783 | 673 | 1937 | 1302 |
| 4 mg × 2 | A13V071 | 1972 | 104 | 102 | 636 | 91 |
| | 05C043 | 2600 | 465 | 953 | 2175 | 1985 |
| | A13V042 | 2788 | 832 | 245 | 529 | — |
| | 22612 | 1428 | 204 | 163 | 288 | 17 |
| | 14012 | 5816 | 2443 | 1597 | 2908 | 2196 |
| VRC5288 | A13V120 | 413 | 35 | <10 | nd | — |
| 1 mg × 1 | A13V101 | 233 | 10 | <10 | nd | — |
| | A5V033 | 377 | 90 | <10 | nd | — |
| | A13V061 | 408 | 16 | <10 | nd | — |
| | 13812 | 316 | 88 | <10 | nd | — |
| | 21412 | 183 | 20 | <10 | nd | — |

RVP = reporter virus particle neutralization assay,
MN = microneutralization assay,
FRNT = focus reduction neutralization test,
NHP = non-human primate,
AVE = average of the indicated number of experiments,
STDEV = standard deviation,
nd = not determined,
— = standard deviation not available because sample not tested or only tested n = 1.

Quantitative RT-PCR. RT-PCR was used to determine viral loads as previously described (12). Briefly, RNA was extracted using a QIAcube HT (Qiagen, Germany). Primers were designed to amplify a region the capsid gene from ZIKV BeH815744. Viral load assays were performed at BIDMC and assay sensitivity was 100 copies/ml.

Eight weeks after the first immunization, all animals were challenged subcutaneously with $10^3$ focus-forming units (FFU) of the Puerto Rican ZIKV strain PRVABC59 (GenBank KU501215.1) and blood was collected daily for quantitative PCR analysis of ZIKV genome copies in plasma (12). This analysis was blinded to group, animal number, and day and deconvoluted by an independent examiner. Control animals showed peak virus load (VL) on day 3 or 4 between $10^4$ and $10^6$ genome copies/ml. Animals that received two doses of 4 mg or 1 mg of VRC5283 or 4 mg of VRC5288 were largely protected from viremia with 17 of 18 animals having no detectable viremia on any day (FIG. 3A). One animal that received two 4 mg doses of VRC5288 had a low-level positive PCR in one of two assays performed on day 3 plasma and another blip at day 7. All six animals that received only a single dose of 1 mg of VRC5288 were viremic with peak VL on day 3 between $10^2$ and $10^5$ genome copies/ml. This viral load was significantly reduced compared to the animals that received two doses of the VRC8400 control vector when comparing area under the curve (AUC) by a Wilcoxon Exact Test (two-sided p=0.041). The reproducibility and cutoff for low values has been established at <100 genome copies/ml, so it cannot be ruled out that low level viremia may have occurred in other animals.

Seventeen of eighteen (94%) animals that received 2 doses of vaccine had no detectable viremia post-challenge. The animal with the blips above background at day 3 and 7 in the VRC5288 two-dose 4 mg group had a prechallenge $EC_{50}$ NAb titer of 1218, which was among the lowest titers of all the two-dose vaccine groups (FIG. 4A). These data suggest the threshold for protection from viremia with this challenge dose is a reciprocal $EC_{50}$ serum NAb titer of approximately 1000 as measured using the RVP assay (FIG. 4B). This corresponds roughly to a reciprocal $EC_{50}$ MN titer of 100 (FIG. 10) which is similar to the titer of NAb required to prevent viremia in nonhuman primates passively treated with immune serum (12).

The occurrence of breakthrough viremia provided an opportunity to analyze immune correlates of protection. The level of pre-challenge NAb activity in serum on week 8 correlated with the level of viremia (Day 3: FIG. 4C, Spearman Rho=-0.856, p<0.0001). This correlation remained significant when the day of viremia was varied, and when restricted to the viremic animals. Animals receiving a single dose of 1 mg VRC5288 had prechallenge reciprocal $EC_{50}$ NAb titers measured by the RVP assay between 203 and 417. The two animals with the highest NAb activity were the ones with delayed onset of viremia at day 3. The MN assay, as noted above, at the 6 week time point (2 weeks prechallenge) was <10 in the 1 mg single dose group that uniformly had breakthrough infection (Table 1). Therefore, the larger dynamic range of the RVP assay will allow a more precise definition of the protective threshold needed to prevent viremia in a particular model or against a particular challenge inoculum.

One concern routinely raised about vaccination against flaviviruses is the possibility of enhanced disease if there is incomplete or waning immunity, as observed in a subset of secondary dengue virus infections (31). In this study, the 1 mg single-dose group that received VRC5288 had low, sub-protective levels of neutralizing antibody that resulted in breakthrough infections. In those animals, there were reduced levels of viremia compared to unvaccinated controls and no visible signs of illness or enhancement of replication. Retrospectively, we also determined that one animal in the mock-immunized control group with a detectable level of ZIKV antibody binding, but no neutralizing activity, had pre-existing WNV-specific NAbs (FIG. 11). The level of virus replication in this animal was the median of the group and there was no evidence of disease enhancement in the setting of prior flavivirus exposure.

Vaccine development for ZIKV must be specific and guided by an expanded understanding of ZIKV virology, pathogenesis, immunity, and transmission. It must also be strategic, matching technical and manufacturing feasibility with the target populations that will benefit most from vaccination. In addition, to achieving both rapid deployment and long-term protection, it should be staged. This means that a rapid response to the global health emergency may require a different vaccine approach than the longer term goal of achieving durable immunity in the general population as ZIKV becomes a sporadic, endemic infection. Both VRC5288 and VRC5283 will be evaluated in humans. A Phase 1 clinical trial (NCT02840487) of VRC5288 was launched to test a variety of regimens and doses for safety and immunogenicity. These trials represent the initial efforts to define the level of vaccine-induced NAbs required for prevention of ZIKV viremia. Establishing a functional serological correlate of sterilizing immunity is key for leveraging the information gained from efficacy trials from one candidate vaccine to the next. These studies and others that may evaluate alternative antigen designs and delivery approaches as well as combination vaccine regimens will provide safety and immunogenicity data in humans that will inform the next steps of vaccine development and provide options for achieving both the short-term goal of identifying an intervention to protect women of child-bearing age in the current ZIKV outbreak, and the long-term goal of vaccinating the general population of endemic regions and travelers to those regions.

Example 2. Clinical Trials Using Constructs of the Invention

A phase I clinical trial VRC 319 was initiated to evaluate the safety, tolerability and immunogenicity of the VRC5288 DNA plasmid (encoding SEQ ID NO:114). In this trial, two or three doses of VRC5288 plasmid was administered by needle and syringe in four different regimens (FIG. 12). Immunogenicity was evaluated by a reporter virus particle (RVP) neutralization assay pre-vaccination and 4 weeks after each immunization (FIG. 13A). Four weeks after the final immunization, most subjects in all groups had detectable neutralizing antibodies to ZIKV (FIG. 13b). Subject that received three doses (groups 3 and 4) had a higher response rate compared to the subjects that received two doses (groups 1 and 2). A comparison of neutralizing activity of responders in each group is shown in FIG. 14 with responders having reciprocal EC50 neutralizing titers of 33-847. These data demonstrate that the VRC5288 DNA plasmid is immunogenic in humans and elicits neutralizing antibodies against ZIKV.

A second trial was conducted evaluate the safety, tolerability and immunogenicity of the VRC5283 DNA plasmid (encoding SEQ ID NO:110). This study evaluated three methods of administration: a single injection of 4 mg of VRC5283 in 1.0 ml (Group 1), a split dose of 4 mg of VRC5283 with 2 mg in 0.5 ml being injected in each arm (Group 2), and needle-free administration using the Pharmajet injection device delivered as two 0.5 ml (2 mg) injections, one in each arm (Group 3) (FIG. 15). All groups received three injections at 4 week intervals. Immunogenicity was evaluated using the RVP neutralization assay. A single administration of VRC5283 elicited neutralizing antibody responses in 73% of subjects with a mean reciprocal EC50 neutralizing titer of 43 (FIG. 17). By splitting the dose into two needle and syringe injections, the response rate (92%) and mean reciprocal EC50 neutralizing titers (135) were increased. Needle-free delivery using the Pharmajet device resulted in 100% response rates after 2 doses and improved immunogenicity by 2-fold compared to the split dose needle and syringe group (FIGS. 16 &17). These data demonstrate that the VRC5283 DNA plasmid is immunogenic in humans and elicits neutralizing antibodies against ZIKV in 100% of subjects when administered by PharmaJet. A phase 2/2b began in March 2017 to evaluate safety, immunogenicity and efficacy of the VRC5283 DNA plasmid.

Example 3. Production and Testing of Zika Virus-Based Reporter Virus Particles (RPVs)

This Example demonstrates general methodology that can be used to produce RPVs comprising Zika virus structural proteins of the invention.

Reporter Virus Particle Production

Reporter virus particles (RVP) incorporating the structural proteins of WNV, DENV, or ZIKV were produced by complementation of a previously described sub-genomic GFP-expressing replicon derived from a lineage II strain of WNV (Pierson et al., 2006). DNA expression constructs encoding structural proteins and the WNV replicon were co-transfected into HEK-293T cells (in a 3:1 ratio by mass) using Lipofectamine 3000 per the manufacturer's instructions (Invitrogen). Transfected cells were incubated at 30° C. and RVP-containing supernatants harvested on days 3-6. RVP stocks were filtered through a 0.2 µM membrane and stored in aliquots at −80° C. until use.

RVP Neutralization Studies.

Neutralization studies with ZIKV RVPs were performed using approaches detailed in prior studies with WNV and DENV RVPs (Dowd et al., 2015; Martin et al., 2007; Mukherjee et al., 2014; Pierson et al., 2007). First, Raji-DCSIGNR cells were infected with serial two-fold dilutions of RVP stocks to determine the titer. Briefly, 5×10⁴ cells (100 µl/well) were mixed with an equal volume of RVPs in a 96-well flat-bottom plate and incubated at 37° C. GFP-positive infected cells were detected by flow cytometry 48 h post-infection and the RVP titer calculated. For use in neutralization assays, RVPs were sufficiently diluted to ensure antibody excess at informative points on the dose-response curves. For neutralization studies, 100 µl RVPs were incubated with 100 µl of serial four-fold dilutions of human or murine sera for 1 h at 37° C. to allow for steady-state binding. Antibody-RVP complexes were then used to infect Raji-DCSIGNR cells in duplicate (300 µl total volume/well). Infections were carried out at 37° C. and GFP-positive infected cells detected by flow cytometry 48 h later.

Neutralization results were analyzed by non-linear regression to estimate the dilution of sera required for half-maximal neutralization of infection (EC50 titer) (Prism 6 software; GraphPad). The smallest dilution at which neutralization can be measured with confidence was established using a panel of normal human sera. Neutralization studies with a panel of 29 serum samples were performed starting at an initial dilution of 1:60 (based on a final 300 µl volume of virus particles, cells, and sera). Neutralization titers predicted by non-linear regression of the resulting data were uniformly less than the highest dilution of sera tested and of low confidence. Thus, our assays have a conservative limit of detection at a 1/60 final concentration of sera, considerably lower than the neutralization titers compared within.

The results of this analysis are shown in FIG. 18A-18I. The data confirm studies with fully infectious virus, demonstrating that strain-dependent differences in neutralization sensitivity are small, if present at all. Further, comparison of the mean $EC_{50}$ for all samples evaluated with both RVPs and infectious virus revealed remarkable agreement. (FIGS. 19A & 19B).

REFERENCES

1. N. Wikan, D. R. Smith, Zika virus: history of a newly emerging arbovirus. *Lancet Infect Dis* 16, e119-126 (2016).
2. M. R. Duffy et al., Zika virus outbreak on Yap Island, Federated States of Micronesia. *N Engl J Med* 360, 2536-2543 (2009).
3. V. M. Cao-Lormeau et al., Zika virus, French polynesia, South pacific, 2013. *Emerg Infect Dis* 20, 1085-1086 (2014).
4. G. S. Campos, A. C. Bandeira, S. I. Sardi, Zika Virus Outbreak, Bahia, Brazil. *Emerg Infect Dis* 21, 1885-1886 (2015).
5. S. A. Rasmussen, D. J. Jamieson, M. A. Honein, L. R. Petersen, Zika Virus and Birth Defects—Reviewing the Evidence for Causality. *N Engl J Med* 374, 1981-1987 (2016).
6. J. Lessler et al., Assessing the global threat from Zika virus. *Science* 353, aaf8160 (2016).
7. J. Harrower et al., Sexual Transmission of Zika Virus and Persistence in Semen, New Zealand, 2016. *Emerg Infect Dis* 22, (2016).
8. A. D. Barrett, D. E. Teuwen, Yellow fever vaccine—how does it work and why do rare cases of serious adverse events take place? *Curr Opin Immunol* 21, 308-313 (2009).
9. S. B. Halstead, S. J. Thomas, Japanese encephalitis: new options for active immunization. *Clinical infectious diseases: an official publication of the Infectious Diseases Society of America* 50, 1155-1164 (2010).
10. F. X. Heinz, H. Holzmann, A. Essl, M. Kundi, Field effectiveness of vaccination against tick-borne encephalitis. *Vaccine* 25, 7559-7567 (2007).
11. B. Guy, J. Lang, M. Saville, N. Jackson, Vaccination Against Dengue: Challenges and Current Developments. *Annu Rev Med* 67, 387-404 (2016).
12. P. Abbink et al., Protective efficacy of multiple vaccine platforms against Zika virus challenge in rhesus monkeys. *Science*, (2016).
13. J. E. Ledgerwood et al., A West Nile virus DNA vaccine utilizing a modified promoter induces neutralizing antibody in younger and older healthy adults in a phase I clinical trial. *J Infect Dis* 203, 1396-1404 (2011).
14. S. S. Whitehead, J. E. Blaney, A. P. Durbin, B. R. Murphy, Prospects for a dengue virus vaccine. *Nature reviews. Microbiology* 5, 518-528 (2007).
15. T. C. Pierson, D. H. Fremont, R. J. Kuhn, M. S. Diamond, Structural insights into the mechanisms of antibody-mediated neutralization of flavivirus infection: implications for vaccine development. *Cell Host Microbe* 4, 229-238 (2008).

16. W. Dejnirattisai et al., A new class of highly potent, broadly neutralizing antibodies isolated from viremic patients infected with dengue virus. *Nature immunology* 16, 170-177 (2015).
17. A. Rouvinski et al., Recognition determinants of broadly neutralizing human antibodies against dengue viruses. *Nature*, (2015).
18. I. Ferlenghi et al., Molecular organization of a recombinant subviral particle from tick-borne encephalitis virus. *Mol Cell* 7, 593-602 (2001).
19. G. J. Chang, B. S. Davis, A. R. Hunt, D. A. Holmes, G. Kuno, Flavivirus DNA vaccines: current status and potential. *Ann N Y Acad Sci* 951, 272-285 (2001).
20. A. T. Catanzaro et al., Phase I clinical evaluation of a six-plasmid multiclade HIV-1 DNA candidate vaccine. *Vaccine* 25, 4085-4092 (2007).
21. J. E. Ledgerwood, B. S. Graham, DNA vaccines: a safe and efficient platform technology for responding to emerging infectious diseases. *Hum Vaccin* 5, 623-626 (2009).
22. K. A. Dowd et al., Broadly Neutralizing Activity of Zika Virus-Immune Sera Identifies a Single Viral Serotype. *Cell Rep* 16, 1485-1491 (2016).
23. B. S. Davis et al., West Nile virus recombinant DNA vaccine protects mouse and horse from virus challenge and expresses in vitro a noninfectious recombinant antigen that can be used in enzyme-linked immunosorbent assays. *Journal of virology* 75, 4040-4047 (2001).
24. G. J. Chang et al., Enhancing biosynthesis and secretion of premembrane and envelope proteins by the chimeric plasmid of dengue virus type 2 and Japanese encephalitis virus. *Virology* 306, 170-180 (2003).
25. U. Arora, P. Tyagi, S. Swaminathan, N. Khanna, Virus-like particles displaying envelope domain III of dengue virus type 2 induce virus-specific antibody response in mice. *Vaccine* 31, 873-878 (2013).
26. L. Wang et al., Evaluation of candidate vaccine approaches for MERS-CoV. *Nature communications* 6, 7712 (2015).
27. Y. Okuno, A. Igarashi, K. Fukai, Neutralization tests for dengue and Japanese encephalitis viruses by the focus reduction method using peroxidase-anti-peroxidase staining. *Biken J* 21, 137-147 (1978).
28. H. Zhao et al., Structural Basis of Zika Virus-Specific Antibody Protection. *Cell* 166, 1016-1027 (2016).
29. S. J. Thomas et al., A phase II, randomized, safety and immunogenicity study of a re-derived, live-attenuated dengue virus vaccine in healthy adults. *The American journal of tropical medicine and hygiene* 88, 73-88 (2013).
30. R. A. Larocca et al., Vaccine protection against Zika virus from Brazil. *Nature* 536, 474-478 (2016).
31. M. G. Guzman, M. Alvarez, S. B. Halstead, Secondary infection as a risk factor for dengue hemorrhagic fever/dengue shock syndrome: an historical perspective and role of antibody-dependent enhancement of infection. *Archives of virology* 158, 1445-1459 (2013).
32. C. W. Davis et al., West Nile virus discriminates between DC-SIGN and DC-SIGNR for cellular attachment and infection. *Journal of virology* 80, 1290-1301 (2006).
33. C. Baronti et al., Complete coding sequence of zika virus from a French polynesia outbreak in 2013. *Genome Announc* 2, (2014).
34. J. E. Martin et al., A West Nile virus DNA vaccine induces neutralizing antibody in healthy adults during a phase 1 clinical trial. *J Infect Dis* 196, 1732-1740 (2007).
35. T. C. Pierson et al., A rapid and quantitative assay for measuring antibody-mediated neutralization of West Nile virus infection. *Virology* 346, 53-65 (2006).
36. T. C. Pierson et al., The stoichiometry of antibody-mediated neutralization and enhancement of West Nile virus infection. *Cell Host Microbe* 1, 135-145 (2007).
37. C. Ansarah-Sobrinho, S. Nelson, C. A. Jost, S. S. Whitehead, T. C. Pierson, Temperature-dependent production of pseudoinfectious dengue reporter virus particles by complementation. *Virology* 381, 67-74 (2008).
38. K. A. Dowd, C. R. DeMaso, T. C. Pierson, Genotypic Differences in Dengue Virus Neutralization Are Explained by a Single Amino Acid Mutation That Modulates Virus Breathing. *MBio* 6, (2015).
39. L. A. VanBlargan et al., The type-specific neutralizing antibody response elicited by a dengue vaccine candidate is focused on two amino acids of the envelope protein. *PLoS Pathog* 9, e1003761 (2013).

The foregoing description of the specific embodiments will so fully reveal the general nature of the invention that others can, by applying knowledge within the skill of the art, readily modify and/or adapt for various applications such specific embodiments, without undue experimentation, without departing from the general concept of this disclosure. Therefore, such adaptations and modifications are intended to be within the meaning and range of equivalents of the disclosed embodiments, based on the teaching and guidance presented herein. It is to be understood that the phraseology or terminology herein is for the purpose of description and not of limitation, such that the terminology or phraseology of the present specification is to be interpreted by the skilled artisan in light of the teachings and guidance.

SEQUENCE LISTING (450 sequences)

SEQ ID NO: 1 - DNA, 504 bp, Zika Virus
gcggaggtcactagacgtgggagtgcatactatatgtacttggacagaaacgatgctggggaggccatatcttttccaaccacattggggatgaataagtgttatatacagatcatggatcttggacacatgtgtgatgccaccatgagctatgaatgccctatgctggatgagggggtggaaccagatgacgtcgattgttggtgcaacacgacgtcaacttgggttgtgtacggaacctgccatcacaaaaaaggtgaagcacggagatctagaagagctgtgacgctcccctcccattccactaggaagctgcaaacgcggtcgcaaacctggttggaatcaagagaatacacaaagcacttgattagagtcgaaaactggatcttcaggaaccctggcttcgcgttagcagcagctgccatcgcttggcttttgggaagctcaacgagccaaaaagtcatatacttggtcatgatactgctgattgccccggcatacagc

SEQ ID NO: 2 - protein, 168 aa, Zika Virus
AEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYS

SEQ ID NO: 3 - DNA, 1512 bp, Zika Virus
atcaggtgcataggagtcagcaatagggactttgtggaaggtatgtcaggtgggacttgggttgatgttgtcttggaacatggaggttgtgtcaccgtaatggcacaggacaaaccgactgtcgacatagagctggttacaacaacagtcagcaacatggcggaggtaagatcctactgctatgaggcatcaatatcggacatggcttcggacagccgctgcccaacacaaggtgaagcctaccttgacaagcaatcagacactcaatatgtctgcaaaagaacgttagtggacagaggctggggaaatggatgtggactttttggcaaagggagcctggtgacatgcgctaagtttgcatgctccaagaaaatgaccgggaagagcatccagccagagaatctggagtaccggataatgctgtcagttcatggctcccagcacagtgggatgatcgttaatgacacaggacatgaaactgatgagaatagagcgaaggttgagataacgcccaattcaccaagagccgaagccaccctggggggttttggaagcctaggacttgattgtgaaccgaggacaggccttgacttttcagatttgtattacttgactatgaataacaagcactggttggttcacaaggagtggttccacgacattccattaccttggcacgctggggcagacaccggaactccacactggaacaacaaagaagcactggtagagttcaaggacgcacatgccaaaaggcaaactgtcgtggttctagggagtcaagaaggagcagttcacacggcccttgctggagctctggaggctgagatggatggtgcaaagggaaggctgtcctctggccacttgaaatgtcgcctgaaaatggataaacttagattgaagggcgtgtcatactccttgtgtaccgcagcgttcacattcaccaagatcccggctgaaacactgcacgggacagtcacagtggaggtacagtacgcagggacagatggaccttgcaaggtcccagctcagatggcggtggacatgcaaactctgaccccagttgggaggttgataaccgctaaccccgtaatcactgaaagcactgagaactctaagatgatgctggaacttgatccaccatttggggactcttacattgtcataggagtcggggagaagaagatcacccaccactggcacaggagtggcagcaccattggaaaagcatttgaagccactgtgagaggtgccaagagaatggcagtcttgggagacacagcctgggactttggatcagttggaggcgctctcaactcattgggcaagggcatccatcaaatttttggagcagctttcaaatcattgtttggaggaatgtcctggttctcacaaattctcattggaacgttgctgatgtggttgggtctgaacacaaagaatggatctatttcccttatgtgcttggccttagggggagtgttgatcttcttatccacagccgtctctgct

SEQ ID NO: 4 - protein, 504 aa, Zika Virus
IRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 5 - DNA, 129 bp, Zika Virus
attggaaaagcatttgaagccactgtgagaggtgccaagagaatggcagtcttaggagacacagcctgggactttggatcagttggaggcgctctcaactcattgggcaagggcatccatcaaattttt

SEQ ID NO: 6 - protein, 43 aa, Zika Virus
IGKAFEATVRGAKRMAVLGDTAWDFGSVGGALNSLGKGIHQIF

SEQ ID NO: 7 - DNA, 129 bp, Japanese encephalitis virus
ctgggcaaggccttttcaacaactttgaagggagctcagagactggcagcgttaggcgacacagcctgggactttggctctattggaggggtcttcaactctataggaaaagccgttcaccaagtgttt

SEQ ID NO: 8 - protein, 43 aa, Japanese encephalitis virus
LGKAFSTTLKGAQRLAALGDTAWDFGSIGGVFNSIGKAVHQVF

SEQ ID NO: 9 - DNA, 160 bp, Zika Virus
ggagcagctttcaaatcattgtttggaggaatgtcctggttctcacaaattctcattggaacgttgctgatgtggttgggtctgaacacaaagaatggatctatttcccttatgtgcttggccttagggggagtgttgatcttcttatccacagccgtct

SEQ ID NO: 10 - protein, 53 aa, Zika Virus
GAAFKSLFGGMSWFSQILIGTLLMWLGLNTKNGSISLMCLALGGVLIFLSTAV

SEQ ID NO: 11 - DNA, 165 bp, Japanese encephalitis virus
ggcggtgcattcaggacgctctttgggggaatgtcttggatcacacaaggactaatgggggccttacttctttggatgggtgtcaacgcacgagaccggtcaatcgccctggcttttctggccacgggaggtgtgctcgtgtttttagcgaccaatgtgcatgcc

SEQ ID NO: 12 - protein, 55 aa, Japanese encephalitis virus
GGAFRTLFGGMSWITQGLMGALLLWMGVNARDRSIALAFLATGGVLVFLATNVHA

SEQ ID NO: 13 - DNA, 289 bp, Zika Virus
attggaaaagcatttgaagccactgtgagaggtgccaagagaatggcagtcttaggagacacagcctgggactttggatcagttggaggcgctctcaactcattgggcaagggcatccatcaaatttttggagcagctttcaaatcattgtttggaggaatgtcctggttctcacaaattctcattggaacgttgctgatgtggttgggtctgaacacaaagaatggatctatttcccttatgtgcttggccttagggggagtgttgatcttcttatccacagccgtct

SEQ ID NO: 14 - protein, 96 aa, Zika Virus
IGKAFEATVRGAKRMAVLGDTAWDFGSVGGALNSLGKGIHQIFGAAFKSLFGGMSWFSQILIGTLLMWLGLNTKNGSISLMCLALGGVLIFLSTAV

SEQ ID NO: 15 - DNA, 294 bp, Japanese encephalitis virus
ctgggcaaggccttttcaacaactttgaagggagctcagagactggcagcgttaggcgacacagcctgggactttggctctattggaggggtcttcaactctataggaaaagccgttcaccaagtgtttggcggtgcattcaggacgctctttgggggaatgtcttggatcacacaaggactaatgggggccttacttctttggatgggtgtcaacgcacgagaccggtcaatcgccctggcttttctggccacgggaggtgtgctcgtgtttttagcgaccaatgtgcatgcc

SEQ ID NO: 16 - protein, 98 aa, Japanese encephalitis virus
LGKAFSTTLKGAQRLAALGDTAWDFGSIGGVFNSIGKAVHQVFGGAFRTLFGGMSWITQGLMGALLLWMGVNARDRSIALAFLATGGVLVFLATNVHA

SEQ ID NO: 17 - DNA, 54 bp, Japanese encephalitis virus
ggctcaatcatgtggctcgcgagcttggcagttgtcatagcttgtgcaggagcc

SEQ ID NO: 18 - protein, 18 aa, Japanese encephalitis virus
GSIMWLASLAVVIACAGA

SEQ ID NO: 19 - DNA, 72 bp, Homo sapiens
atgccgatgcaatccctgcagcccctggccaccctgtacctgctgggcatgctggtggcctccgtgctggcc

SEQ ID NO: 20 - protein, 24 aa, Homo sapiens
MPMQSLQPLATLYLLGMLVASVLA

SEQ ID NO: 21 - DNA, 54 bp, Zika Virus
ggcgcagatactagtgtcggaattgttggcctcctgctgaccacagctatggca

SEQ ID NO: 22 - protein, 18 aa, Zika Virus
GADTSVGIVGLLLTTAMA

SEQ ID NO: 23 - DNA, 69 bp, Murine
atgtacagcatgcagctcgcatcctgtgtcacactgacacttgtgctccttgtcaacagcgcacccaga

SEQ ID NO: 24 - protein, 23 aa, Murine
MYSMQLASCVTLTLVLLVNSAPR

SEQ ID NO: 25 - DNA, 84 bp, Bovine
atggacagcaaaggttcgtcgcagaaagggtcccgcctgctcctgctgctggtggtgtcaaatctactcttgtgccagggtgtg

SEQ ID NO: 26 - protein, 30 aa, Bovine
MDSKGSSQKGSRLLLLLVVSNLLLPQGVLA

SEQ ID NO: 27 - protein, 93 aa, Zika Virus
AEVTRRGSAYYMYLDRNDAGEAISFPTTLGMNKCYIQIMDLGHMCDATMSYECPMLDEGVEPDDVDCWCNTTSTWVVYGTCHHKKGEARRSRR

SEQ ID NO: 28 - protein, 75 aa, Zika Virus
AVTLPSHSTRKLQTRSQTWLESREYTKHLIRVENWIFRNPGFALAAAAIAWLLGSSTSQKVIYLVMILLIAPAYS

SEQ ID NO: 29 - protein, 693 aa, Artificial Sequence
  Synthetic
MGKRSAGSIMWLASLAVVIACAGATRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 30 - protein, 688 aa, Artificial Sequence
  Synthetic
MGWSCIILFLVATATGVHSTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 31 - protein, 670 aa, Artificial Sequence
  Synthetic
MTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 32 - protein, 528 aa, Artificial Sequence
  Synthetic
MGKRSAGSIMWLASLAVVIACAGAIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 33 - protein, 523 aa, Artificial Sequence
  Synthetic
MGWSCIILFLVATATGVHSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 34 - protein, 505 aa, Artificial Sequence
  Synthetic
MIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 35 - protein, 535 aa, Artificial Sequence
  Synthetic
MIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSAGLNDIFEAQKIEWHELEVLFQGPGHHHHHH

SEQ ID NO: 36 - protein, 457 aa, Artificial Sequence
  Synthetic
MIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSL

SEQ ID NO: 37 - protein, 487 aa, Artificial Sequence
  Synthetic
MIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLGLNDIFEAQKIEWHELEVLFQGPGHHHHHH

SEQ ID NO: 38 - protein, 480 aa, Artificial Sequence
  Synthetic
MGKRSAGSIMWLASLAVVIACAGAIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSL

SEQ ID NO: 39 - protein, 475 aa, Artificial Sequence
  Synthetic
MGWSCIILFLVATATGVHSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSL

SEQ ID NO: 40 - protein, 520 aa, Artificial Sequence
  Synthetic
MGKRSAGSIMWLASLAVVIACAGAIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDGSGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 41 - protein, 528 aa, Artificial Sequence
  Synthetic
MGKRSAGSIMWLASLAVVIACAGAIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVNQGAGNGCGAAGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 42 - protein, 472 aa, Artificial Sequence
  Synthetic
MGKRSAGSIMWLASLAVVIACAGAIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDGSGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSL

SEQ ID NO: 43 - protein, 480 aa, Artificial Sequence
  Synthetic
MGKRSAGSIMWLASLAVVIACAGAIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVNQGAGNGCGAAGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSL

SEQ ID NO: 44 - protein, 502 aa, Artificial Sequence
  Synthetic
MGKRSAGSIMWLASLAVVIACAGAIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDGSGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLGLNDIFEAQKIEWHELEVLFQGPGHHHHHH

SEQ ID NO: 45 - protein, 510 aa, Artificial Sequence
  Synthetic
MGKRSAGSIMWLASLAVVIACAGAIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVNQGAGNGCGAAGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLGLNDIFEAQKIEWHELEVLFQGPGHHHHHH

SEQ ID NO: 46 - protein, 693 aa, Artificial Sequence
  Synthetic
MGKRSAGSIMWLASLAVVIACAGATRRGSAYYMYLDRNDAGEAISFPTTLGMNKCYIQIMDLGHMCDATMSYECPMLDEGVEPDDVDCWCNTTSTWVVYGTCHHKKGERRRRRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 47 - protein, 693 aa, Artificial Sequence
  Synthetic
MGKRSAGSIMWLASLAVVIACAGATRRGSAYYMYLDRNDAGEAISFPTTLGMNKCYIQIMDLGHMCDATMSYECPMLDEGVEPDDVDCWCNTTSTWVVYGTCHHKKGERRRKRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 48 - protein, 685 aa, Artificial Sequence
  Synthetic
MGKRSAGSIMWLASLAVVIACAGATRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDGSGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 49 - protein, 693 aa, Artificial Sequence
  Synthetic
MGKRSAGSIMWLASLAVVIACAGATRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVNQGAGNGCGAAGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 50 - protein, 685 aa, Artificial Sequence
  Synthetic
MGKRSAGSIMWLASLAVVIACAGATRRGSAYYMYLDRNDAGEAISFPTTLGMNKCYIQIMDLGHMCDATMSYECPMLDEGVEPDDVDCWCNTTSTWVVYGTCHHKKGERRRRRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDGSGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 51 - protein, 685 aa, Artificial Sequence
  Synthetic
MGKRSAGSIMWLASLAVVIACAGATRRGSAYYMYLDRNDAGEAISFPTTLGMNKCYIQIMDLGHMCDATMSYECPMLDEGVEPDDVDCWCNTTSTWVVYGTCHHKKGERRRKRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDGSGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 52 - protein, 693 aa, Artificial Sequence
  Synthetic
MGKRSAGSIMWLASLAVVIACAGATRRGSAYYMYLDRNDAGEAISFPTTLGMNKCYIQIMDLGHMCDATMSYECPMLDEGVEPDDVDCWCNTTSTWVVYGTCHHKKGERRRRRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVNQGAGNGCGAAGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 53 - protein, 693 aa, Artificial Sequence
  Synthetic
MGKRSAGSIMWLASLAVVIACAGATRRGSAYYMYLDRNDAGEAISFPTTLGMNKCYIQIMDLGHMCDATMSYECPMLDEGVEPDDVDCWCNTTSTWVVYGTCHHKKGERRRKRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVNQGAGNGCGAAGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 54 - protein, 637 aa, Artificial Sequence
  Synthetic
MGKRSAGSIMWLASLAVVIACAGATRRGSAYYMYLDRNDAGEAISFPTTLGMNKCYIQIMDLGHMCDATMSYECPMLDEGVEPDDVDCWCNTTSTWVVYGTCHHKKGERRRRRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDGSGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSL

SEQ ID NO: 55 - protein, 637 aa, Artificial Sequence
  Synthetic
MGKRSAGSIMWLASLAVVIACAGATRRGSAYYMYLDRNDAGEAISFPTTLGMNKCYIQIMDLGHMCDATMSYECPMLDEGVEPDDVDCWCNTTSTWVVYGTCHHKKGERRRKRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDGSGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSL

SEQ ID NO: 56 - protein, 645 aa, Artificial Sequence
  Synthetic
MGKRSAGSIMWLASLAVVIACAGATRRGSAYYMYLDRNDAGEAISFPTTLGMNKCYIQIMDLGHMCDATMSYECPMLDEGVEPDDVDCWCNTTSTWVVYGTCHHKKGERRRRRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVNQGAGNGCGAAGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSL

SEQ ID NO: 57 - protein, 645 aa, Artificial Sequence
  Synthetic
MGKRSAGSIMWLASLAVVIACAGATRRGSAYYMYLDRNDAGEAISFPTTLGMNKCYIQIMDLGHMCDATMSYECPMLDEGVEPDDVDCWCNTTSTWVVYGTCHHKKGERRRKRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVNQGAGNGCGAAGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSL

SEQ ID NO: 58 - protein, 693 aa, Artificial Sequence
  Synthetic
MGKRSAGSIMWLASLAVVIACAGATRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSSIGKAFTTTLKGAQRLAALGDTAWDFGSVGGVFTSVGKAVHQVFGGAFRSLFGGMSWITQGLLGALLLWMGINARDRSIALTFLAVGGVLLFLSVNVHA

SEQ ID NO: 59 - protein, 693 aa, Artificial Sequence
  Synthetic
MGKRSAGSIMWLASLAVVIACAGATRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTLGKAFSTTLKGAQRLAALGDTAWDFGSIGGVFNSIGKAVHQVFGGAFRTLFGGMSWITQGLMGALLLWMGVNARDRSIALAFLATGGVLVFLATNVHA

SEQ ID NO: 60 - protein, 528 aa, Artificial Sequence
  Synthetic
MGKRSAGSIMWLASLAVVIACAGAIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSSIGKAFTTTLKGAQRLAALGDTAWDFGSVGGVFTSVGKAVHQVFGGAFRSLFGGMSWITQGLLGALLLWMGINARDRSIALTFLAVGGVLLFLSVNVHA

SEQ ID NO: 61 - protein, 528 aa, Artificial Sequence
  Synthetic
MGKRSAGSIMWLASLAVVIACAGAIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTLGKAFSTTLKGAQRLAALGDTAWDFGSIGGVFNSIGKAVHQVFGGAFRTLFGGMSWITQGLMGALLLWMGVNARDRSIALAFLATGGVLVFLATNVHA

SEQ ID NO: 62 - protein, 693 aa, Artificial Sequence
  Synthetic
MGKRSAGSIMWLASLAVVIACAGATRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSSIGKMFESTYRGAKRMAILGETAWDFGSVGGLLTSLGKAVHQVFGSVYTTMFGGVSWMVRILIGLLVLWIGTNSRNTSMAMSCIAVGGITLFLGFTVHA

SEQ ID NO: 63 - protein, 528 aa, Artificial Sequence
  Synthetic
MGKRSAGSIMWLASLAVVIACAGAIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSSIGKMFESTYRGAKRMAILGETAWDFGSVGGLLTSLGKAVHQVFGSVYTTMFGGVSWMVRILIGLLVLWIGTNSRNTSMAMSCIAVGGITLFLGFTVHA

SEQ ID NO: 64 - protein, 610 aa, Artificial Sequence
  Synthetic
MGKRSAGSIMWLASLAVVIACAGAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRAETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNETTEHGTTATITPQAPTSEIQLTDYGTLTLDCSPRTGLDFNEMVLLTMKERSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGATQNGRLITANPIVTDKEKPVNIEAEPPFGESYIVVGAGEKALKLSWFKKGSSGKPIPNPLLGLDSTRTGHHHHHH

SEQ ID NO: 65 - protein, 610 aa, Artificial Sequence
  Synthetic
MGKRSAGSIMWLASLAVVIACAGAFHLTTRNGEPHMIVSRQEKGKSLLFKTEDGVNMCTLMAMDLGELCEDTITYKCPFLKQNEPEDIDCWCNSTSTWVTYGTCTTTGEHRREKRSVALVPHVGMGLETRTETWMSSEGAWKHAQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTDSRCPTQGEPSLNEEQDKRFVCKHSMVDRGWGNGCGLFGKGGIVTCAMFTCKKNMKGKVVQPENLEYTIVITPHSGEEHAVGNDTGKHGKEIKITPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYDGDGSPCKIPFEIMDLEKRHVLGRLITVNPIVTEKDSPVNIEAEPPFGDSYIIIGVEPGQLKLNWFKKGSSGKPIPNPLLGLDSTRTGHHHHHH

SEQ ID NO: 66 - protein, 617 aa, Artificial Sequence
  Synthetic
MGKRSAGSIMWLASLAVVIACAGAVTLSNFQGKVMMTVNATDVTDVITIPTAAGKNLCIVRAMDVGYMCDDTITYECPVLSAGNDPEDIDCWCTKSAVYVRYGRCTKTRHSRRSRRSLTVQTHGESTLANKKGAWMDSTKATRYLVKTESWILRNPGYALVAAVIGWMLGSNTMQRVVFVVLLLLVAPAYSFNCLGMSNRDFLEGVSGATWVDLVLEGDSCVTIMSKDKPTIDVKMMNMEAANLAEVRSYCYLATVSDLSTKAACPTMGEAHNDKRADPAFVCRQGVVDRGWGNGCGLFGKGSIDTCAKFACSTKAIGRTILKENIKYEVAIFVHGPTTVESHGNYSTQVGATQAGRFSITPAAPSYTLKLGEYGEVTVDCEPRSGIDTNAYYVMTVGTKTFLVHREWFMDLNLPWSSAGSTVWRNRETLMEFEEPHATKQSVIALGSQEGALHQALAGAIPVEFSSNTVKLTSGHLKCRVKMEKLQSKGTTYGVCSKAFKFLGTPADTGHGTVVLELQYTGTDGPCKVPISSVASLNDLTPVGRLVTVNPFVSVATANAKVLIELEPPFGDSYIVVGRGEQQINHHWHKSGSSGKPIPNPLLGLDSTRTGHHHHHH

SEQ ID NO: 67 - protein, 621 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTGKPIPNPLLGLDSTRTGHHHHHH

SEQ ID NO: 68 - protein, 610 aa, Artificial Sequence
  Synthetic
MGKRSAGSIMWLASLAVVIACAGAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRAETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGRGNGCGLFGKGSLITCAKFKCVTKLEGKIVQYENLKYSVIVTVHTGDQHQVGNETTEHGTTATITPQAPTSEIQLTDYGTLTLDCSPRTGLDFNEMVLLTMKERSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGATQNGRLITANPIVTDKEKPVNIEAEPPFGESYIVVGAGEKALKLSWFKKGSSGKPIPNPLLGLDSTRTGHHHHHH

SEQ ID NO: 69 - protein, 610 aa, Artificial Sequence
  Synthetic
MGKRSAGSIMWLASLAVVIACAGAFHLTTRNGEPHMIVSRQEKGKSLLFKTEDGVNMCTLMAMDLGELCEDTITYKCPFLKQNEPEDIDCWCNSTSTWVTYGTCTTTGEHRREKRSVALVPHVGMGLETRTETWMSSEGAWKHAQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTDSRCPTQGEPSLNEEQDKRFVCKHSMVDRGRGNGCGLFGKGGIVTCAMFTCKKNMKGKVVQPENLEYTIVITPHSGEEHAVGNDTGKHGKEIKITPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYDGDGSPCKIPFEIMDLEKRHVLGRLITVNPIVTEKDSPVNIEAEPPFGDSYIIIGVEPGQLKLNWFKKGSSGKPIPNPLLGLDSTRTGHHHHHH

SEQ ID NO: 70 - protein, 617 aa, Artificial Sequence
  Synthetic
MGKRSAGSIMWLASLAVVIACAGAVTLSNFQGKVMMTVNATDVTDVITIPTAAGKNLCIVRAMDVGYMCDDTITYECPVLSAGNDPEDIDCWCTKSAVYVRYGRCTKTRHSRRSRRSLTVQTHGESTLANKKGAWMDSTKATRYLVKTESWILRNPGYALVAAVIGWMLGSNTMQRVVFVVLLLLVAPAYSFNCLGMSNRDFLEGVSGATWVDLVLEGDSCVTIMSKDKPTIDVKMMNMEAANLAEVRSYCYLATVSDLSTKAACPTMGEAHNDKRADPAFVCRQGVVDRGRGNGCGLFGKGSIDTCAKFACSTKAIGRTILKENIKYEVAIFVHGPTTVESHGNYSTQVGATQAGRFSITPAAPSYTLKLGEYGEVTVDCEPRSGIDTNAYYVMTVGTKTFLVHREWFMDLNLPWSSAGSTVWRNRETLMEFEEPHATKQSVIALGSQEGALHQALAGAIPVEFSSNTVKLTSGHLKCRVKMEKLQSKGTTYGVCSKAFKFLGTPADTGHGTVVLELQYTGTDGPCKVPISSVASLNDLTPVGRLVTVNPFVSVATANAKVLIELEPPFGDSYIVVGRGEQQINHHWHKSGSSGKPIPNPLLGLDSTRTGHHHHHH

SEQ ID NO: 71 - protein, 621 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGRGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTGKPIPNPLLGLDSTRTGHHHHHH

SEQ ID NO: 72 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 73 - protein, 794 aa, Artificial Sequence
  Synthetic
MKNPKKKSGGFRIVNMLKRGVARVNPLGGLKRLPAGLLLGHGPIRMVLAILAFLRFTAIKPSLGLINRWGSVGKKEAMEIIKKFKKDLAAMLRIINARKERKRRGADTSIGIIGLLLTTAMAAEITRRGSAYYMYLDRSDAGKAISFATNLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALAAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIVNDIGHETDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKVPAQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGVHQIFGAAFKSLFGGMSWFSQILIGTLLVWLGLNTKNGSISLTCLALGGVMIFLSTAVSA

SEQ ID NO: 74 - protein, 696 aa, Artificial Sequence
  Synthetic
MGKRSAGSIMWLASLAVVIACAGAAEITRRGSAYYMYLDRSDAGKAISFATNLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALAAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIVNDIGHETDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKVPAQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGVHQIFGAAFKSLFGGMSWFSQILIGTLLVWLGLNTKNGSISLTCLALGGVMIFLSTAVSA

SEQ ID NO: 75 - protein, 794 aa, Artificial Sequence
  Synthetic
MKNPKKRSGGFRIVNMLKRGVARVNPLGGLKRLPAGLLLGHGPIRMVLAILAFLRFTAIKPSLGLINRWGSVGKKEAMEIIKKFKKDLAAMLRIINARKERKRRGADTSIGIVGLLLTTAMAAEITRRGSAYYMYLDRSDAGKAISFATTLGVNKCHVQIMDLGHMCDATMSYECPMLDEGVEPDDVDCWCNTTSTWVVYGTCQHKKGEARRSRRAVTLPSHSTRKLQTRSQTWLESREYTKHLIKVENWIFRNPGFALVAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIVNDIGHETDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAVCTAAKVPAETLHGTVTVEVQYAGTDGPCKVPAQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSA

SEQ ID NO: 76 - protein, 696 aa, Artificial Sequence
  Synthetic
MGKRSAGSIMWLASLAVVIACAGAAEITRRGSAYYMYLDRSDAGKAISFATTLGVNKCHVQIMDLGHMCDATMSYECPMLDEGVEPDDVDCWCNTTSTWVVYGTCQHKKGEARRSRRAVTLPSHSTRKLQTRSQTWLESREYTKHLIKVENWIFRNPGFALVAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIVNDIGHETDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAVCTAAKVPAETLHGTVTVEVQYAGTDGPCKVPAQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSA

SEQ ID NO: 77 - protein, 790 aa, Artificial Sequence
  Synthetic
MKNPKEEIRRIRIVNMLKRGVARVNPLGGLKRLPAGLLLGHGPIRMVLAILAFLRFTAIKPSLGLINRWGSVGKKEAMEIIKKFKKDLAAMLRIINARKERKRRGADTSIGIIGLLLTTAMAAEITRRGSAYYMYLDRSDAGKAISFATTLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALVAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIGYETDEDRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKIPVQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSA

SEQ ID NO: 78 - protein, 692 aa, Artificial Sequence
  Synthetic
MGKRSAGSIMWLASLAVVIACAGAAEITRRGSAYYMYLDRSDAGKAISFATTLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALVAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIGYETDEDRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKIPVQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSA

SEQ ID NO: 79 - protein, 794 aa, Artificial Sequence
  Synthetic
MKNPKKKSGGFRIVNMLKRGVARVNPLGGLKRLPAGLLLGHGPIRMVLAILAFLRFTAIKPSLGLINRWGSVGKKEAMEIIKKFKKDLAAMLRIINARKERKRRGADTSIGIIGLLLTTAMAAEITRRGSAYYMYLDRSDAGKAISFATTLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALVAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIVNDTGYETDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGKLFSGHLKCRLKMDKLRLKGVSYSLCTAAFTFTKVPAETLHGTVTVEVQYAGTDGPCKIPVQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSA

SEQ ID NO: 80 - protein, 696 aa, Artificial Sequence
  Synthetic
MGKRSAGSIMWLASLAVVIACAGAAEITRRGSAYYMYLDRSDAGKAISFATTLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALVAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIVNDTGYETDENRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGKLFSGHLKCRLKMDKLRLKGVSYSLCTAAFTFTKVPAETLHGTVTVEVQYAGTDGPCKIPVQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSA

SEQ ID NO: 81 - protein, 794 aa, Artificial Sequence
  Synthetic
MKNPKKKSGGFRIVNMLKRGVARVSPFGGLKRLPAGLLLGHGPIRMVLAILAFLRFTAIKPSLGLINRWGSVGKKEAMEIIKKFKKDLAAMLRIINARKEKKRRGADTSVGIVGLLLTTAMAVEVTRRGSAYYMYLDRSDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAVIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLVWLGLNTKNGSISLTCLALGGVLIFLSTAVSA

SEQ ID NO: 82 - protein, 696 aa, Artificial Sequence
  Synthetic
MGKRSAGSIMWLASLAVVIACAGAVEVTRRGSAYYMYLDRSDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAVIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLVWLGLNTKNGSISLTCLALGGVLIFLSTAVSA

SEQ ID NO: 83 - protein, 794 aa, Artificial Sequence
  Synthetic
MKNPKKKSGGFRIVNMLKRGVARVSPFGGLKRLPAGLLLGHGPIRMVLAILAFLRFTAIKPSLGLINRWGSVGKKEAMEIIKKFKKDLAAMLRIINARKEKKRRGTDTSVGIVGLLLTTAMAAEVTRRGSAYYMYLDRSDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHTGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITEGTENSKMMLELDPPFGDSYIVIGVGEKKITHHWHRSGSTIGKAFEATVRGAKRMAVLGDTAWDFGSVGGVLNSLGKGIHQIFGAAFKSLFGGMSWFSQILIGTLLMWLGLNTKNGSISLMCLALGGVLIFLSTAVSA

SEQ ID NO: 84 - protein, 696 aa, Artificial Sequence
  Synthetic
MGKRSAGSIMWLASLAVVIACAGAAEVTRRGSAYYMYLDRSDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHTGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITEGTENSKMMLELDPPFGDSYIVIGVGEKKITHHWHRSGSTIGKAFEATVRGAKRMAVLGDTAWDFGSVGGVLNSLGKGIHQIFGAAFKSLFGGMSWFSQILIGTLLMWLGLNTKNGSISLMCLALGGVLIFLSTAVSA

SEQ ID NO: 85 - protein, 794 aa, Artificial Sequence
  Synthetic
MKNPKKKSGGFRIVNMLKRGVARVSPFGGLKRLPAGLLLGHGPIRMVLAILAFLRFTAIKPSLGLINRWGSVGKKEAMEIIKKFKKDLAAMLRIINARKEKKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDAGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 86 - protein, 794 aa, Artificial Sequence
  Synthetic
MKNPKKKSGGFRIVNMLKRGVARVSPFGGLKRLPAGLLLGHGPIRMVLAILAFLRFTAIKPSLGLINRWGSVGKKEAMEIIKKFKKDLAAMLRIINARKEKKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGPTTVESHGNYATQVGATQAAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 87 - protein, 789 aa, Artificial Sequence
  Synthetic
MKNPKKKSGGFRIVNMLKRGVARVSPFGGLKRLPAGLLLGHGPIRMVLAILAFLRFTAIKPSLGLINRWGSVGKKEAMEIIKKFKKDLAAMLRIINARKEKKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHTGDQHQVGNEATEHGAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 88 - protein, 789 aa, Artificial Sequence
  Synthetic
MKNPKKKSGGFRIVNMLKRGVARVSPFGGLKRLPAGLLLGHGPIRMVLAILAFLRFTAIKPSLGLINRWGSVGKKEAMEIIKKFKKDLAAMLRIINARKEKKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHSGEEHAVGNDAGKHGAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 89 - protein, 791 aa, Artificial Sequence
  Synthetic
MSKKPGGPCKSRAVNMLKRGMPRVLSLIGLKRAMLSLIDGKGPIRFVLALLAFFRFTAIAPTRAVLDRWRGVNKQTAMKHLLSFKKELGTLTSAINRRSSKQKKRGGKTGIAVMIGLIASVGAVTLSNFQGKVMMTVNATDVTDVITIPTAAGKNLCIVRAMDVGYMCDDTITYECPVLSAGNDPEDIDCWCTKSAVYVRYGRCTKTRHSRRSRRSLTVQTHGESTLANKKGAWMDSTKATRYLVKTESWILRNPGYALVAAVIGWMLGSNTMQRVVFVVLLLLVAPAYSFNCLGMSNRDFLEGVSGATWVDLVLEGDSCVTIMSKDKPTIDVKMMNMEAANLAEVRSYCYLATVSDLSTKAACPTMGEAHNDKRADPAFVCRQGVVDRGWGNGCGLFGKGSIDTCAKFACSTKAIGRTILKENIKYEVAIFVHGSQHSGMIVNDAGHETDENRGRFSITPAAPSYTLKLGEYGEVTVDCEPRSGIDTNAYYVMTVGTKTFLVHREWFMDLNLPWSSAGSTVWRNRETLMEFEEPHATKQSVIALGSQEGALHQALAGAIPVEFSSNTVKLTSGHLKCRVKMEKLQSKGTTYGVCSKAFKFLGTPADTGHGTVVLELQYTGTDGPCKVPISSVASLNDLTPVGRLVTVNPFVSVATANAKVLIELEPPFGDSYIVVGRGEQQINHHWHKSGSSIGKAFTTTLKGAQRLAALGDTAWDFGSVGGVFTSVGKAVHQVFGGAFRSLFGGMSWITQGLLGALLLWMGINARDRSIALTFLAVGGVLLFLSVNVHA

SEQ ID NO: 90 - protein, 780 aa, Artificial Sequence
  Synthetic
MINQRKKTGRPSFNMLKRARNRVSTVSQLAKRFSKGLLSGQGPMKLVMAFIAFLRFLAIPPTAGILARWGSFKKNGAIKVLRGFKREISNMLNIMNRRKRSVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRAETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHGSQHSGMIVNDAGHETDENRTTATITPQAPTSEIQLTDYGTLTLDCSPRTGLDFNEMVLLTMKERSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGATQNGRLITANPIVTDKEKPVNIEAEPPFGESYIVVGAGEKALKLSWFKKGSSIGKMFEATARGARRMAILGDTAWDFGSIGGVFTSMGKLVHQVFGTAYGVLFSGVSWTMKIGIGILLTWLGLNSRNTSLSMMCIAVGMVTLYLGVMVQA

SEQ ID NO: 91 - protein, 780 aa, Artificial Sequence
  Synthetic
MNNQRKKAKNTPFNMLKRERNRVSTVQQLTKRFSLGMLQGRGPLKLFMALVAFLRFLTIPPTAGILKRWGTIKKSKAINVLRGFRKEIGRMLNILNRRRRSAGMIIMLIPTVMAFHLTTRNGEPHMIVSRQEKGKSLLFKTEDGVNMCTLMAMDLGELCEDTITYKCPLLRQNEPEDIDCWCNSTSTWVTYGTCTTMGEHRREKRSVALVPHVGMGLETRTETWMSSEGAWKHVQRIETWILRHPGFTMMAAILAYTIGTTHFQRALIFILLTAVTPSMTMRCIGMSNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFRCKKNMEGKVVQPENLEYTIVITPHGSQHSGMIVNDAGHETDENRKEIKITPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVTLVLVGIVTLYLGVMVQA

SEQ ID NO: 92 - protein, 794 aa, Artificial Sequence
  Synthetic
MKNPKKKSGGFRIVNMLKRGVARVSPFGGLKRLPAGLLLGHGPIRMVLAILAFLRFTAIKPSLGLINRWGSVGKKEAMEIIKKFKKDLAAMLRIINARKEKKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGPTTVESHGNYSTQVGATQAAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 93 - protein, 789 aa, Artificial Sequence
  Synthetic
MKNPKKKSGGFRIVNMLKRGVARVSPFGGLKRLPAGLLLGHGPIRMVLAILAFLRFTAIKPSLGLINRWGSVGKKEAMEIIKKFKKDLAAMLRIINARKEKKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHTGDQHQVGNETTEHGAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 94 - protein, 789 aa, Artificial Sequence
  Synthetic
MKNPKKKSGGFRIVNMLKRGVARVSPFGGLKRLPAGLLLGHGPIRMVLAILAFLRFTAIKPSLGLINRWGSVGKKEAMEIIKKFKKDLAAMLRIINARKEKKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHSGEEHAVGNDTGKHGAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 95 - protein, 791 aa, Artificial Sequence
  Synthetic
MSKKPGGPCKSRAVNMLKRGMPRVLSLIGLKRAMLSLIDGKGPIRFVLALLAFFRFTAIAPTRAVLDRWRGVNKQTAMKHLLSFKKELGTLTSAINRRSSKQKKRGGKTGIAVMIGLIASVGAVTLSNFQGKVMMTVNATDVTDVITIPTAAGKNLCIVRAMDVGYMCDDTITYECPVLSAGNDPEDIDCWCTKSAVYVRYGRCTKTRHSRRSRRSLTVQTHGESTLANKKGAWMDSTKATRYLVKTESWILRNPGYALVAAVIGWMLGSNTMQRVVFVVLLLLVAPAYSFNCLGMSNRDFLEGVSGATWVDLVLEGDSCVTIMSKDKPTIDVKMMNMEAANLAEVRSYCYLATVSDLSTKAACPTMGEAHNDKRADPAFVCRQGVVDRGWGNGCGLFGKGSIDTCAKFACSTKAIGRTILKENIKYEVAIFVHGSQHSGMIVNDTGHETDENRGRFSITPAAPSYTLKLGEYGEVTVDCEPRSGIDTNAYYVMTVGTKTFLVHREWFMDLNLPWSSAGSTVWRNRETLMEFEEPHATKQSVIALGSQEGALHQALAGAIPVEFSSNTVKLTSGHLKCRVKMEKLQSKGTTYGVCSKAFKFLGTPADTGHGTVVLELQYTGTDGPCKVPISSVASLNDLTPVGRLVTVNPFVSVATANAKVLIELEPPFGDSYIVVGRGEQQINHHWHKSGSSIGKAFTTTLKGAQRLAALGDTAWDFGSVGGVFTSVGKAVHQVFGGAFRSLFGGMSWITQGLLGALLLWMGINARDRSIALTFLAVGGVLLFLSVNVHA

SEQ ID NO: 96 - protein, 780 aa, Artificial Sequence
  Synthetic
MINQRKKTGRPSFNMLKRARNRVSTVSQLAKRFSKGLLSGQGPMKLVMAFIAFLRFLAIPPTAGILARWGSFKKNGAIKVLRGFKREISNMLNIMNRRKRSVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRAETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHGSQHSGMIVNDTGHETDENRTTATITPQAPTSEIQLTDYGTLTLDCSPRTGLDFNEMVLLTMKERSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGATQNGRLITANPIVTDKEKPVNIEAEPPFGESYIVVGAGEKALKLSWFKKGSSIGKMFEATARGARRMAILGDTAWDFGSIGGVFTSMGKLVHQVFGTAYGVLFSGVSWTMKIGIGILLTWLGLNSRNTSLSMMCIAVGMVTLYLGVMVQA

SEQ ID NO: 97 - protein, 780 aa, Artificial Sequence
  Synthetic
MNNQRKKAKNTPFNMLKRERNRVSTVQQLTKRFSLGMLQGRGPLKLFMALVAFLRFLTIPPTAGILKRWGTIKKSKAINVLRGFRKEIGRMLNILNRRRRSAGMIIMLIPTVMAFHLTTRNGEPHMIVSRQEKGKSLLFKTEDGVNMCTLMAMDLGELCEDTITYKCPLLRQNEPEDIDCWCNSTSTWVTYGTCTTMGEHRREKRSVALVPHVGMGLETRTETWMSSEGAWKHVQRIETWILRHPGFTMMAAILAYTIGTTHFQRALIFILLTAVTPSMTMRCIGMSNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFRCKKNMEGKVVQPENLEYTIVITPHGSQHSGMIVNDTGHETDENRKEIKITPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVTLVLVGIVTLYLGVMVQA

SEQ ID NO: 98 - protein, 794 aa, Artificial Sequence; identical to SEQ ID NO: 73
  Synthetic

SEQ ID NO: 99 - protein, 696 aa, Artificial Sequence; identical to SEQ ID NO: 74
  Synthetic

SEQ ID NO: 100 - protein, 794 aa, Artificial Sequence; identical to SEQ ID NO: 75
  Synthetic

SEQ ID NO: 101 - protein, 696 aa, Artificial Sequence; identical to SEQ ID NO: 76
  Synthetic

SEQ ID NO: 102 - protein, 790 aa, Artificial Sequence; identical to SEQ ID NO: 77
  Synthetic

SEQ ID NO: 103 - protein, 692 aa, Artificial Sequence; identical to SEQ ID NO: 78
  Synthetic

SEQ ID NO: 104 - protein, 794 aa, Artificial Sequence; identical to SEQ ID NO: 79
  Synthetic

SEQ ID NO: 105 - protein, 696 aa, Artificial Sequence; identical to SEQ ID NO: 80
  Synthetic

SEQ ID NO: 106 - protein, 794 aa, Artificial Sequence; identical to SEQ ID NO: 81
  Synthetic

SEQ ID NO: 107 - protein, 696 aa, Artificial Sequence; identical to SEQ ID NO: 82
  Synthetic

SEQ ID NO: 108 - protein, 794 aa, Artificial Sequence; identical to SEQ ID NO: 83
  Synthetic

SEQ ID NO: 109 - protein, 696 aa, Artificial Sequence; identical to SEQ ID NO: 84
  Synthetic

SEQ ID NO: 110 - protein, 696 aa, Artificial Sequence; identical to SEQ ID NO: 72
  Synthetic

SEQ ID NO: 111 - protein, 480 aa, Artificial Sequence
  Synthetic
MGKRSAGSIMWLASLAVVIACAGAIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEVEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSL

SEQ ID NO: 112 - protein, 693 aa, Artificial Sequence
  Synthetic
MGKRSAGSIMWLASLAVVIACAGATRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEVEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTLGKAFSTTLKGAQRLAALGDTAWDFGSIGGVFNSIGKAVHQVFGGAFRTLFGGMSWITQGLMGALLLWMGVNARDRSIALAFLATGGVLVFLATNVHA

SEQ ID NO: 113 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEVEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 114 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTLGKAFSTTLKGAQRLAALGDTAWDFGSIGGVFNSIGKAVHQVFGGAFRTLFGGMSWITQGLMGALLLWMGVNARDRSIALAFLATGGVLVFLATNVHA

SEQ ID NO: 115 - protein, 693 aa, Artificial Sequence; identical to SEQ ID NO: 112
  Synthetic

SEQ ID NO: 116 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEVEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTLGKAFSTTLKGAQRLAALGDTAWDFGSIGGVFNSIGKAVHQVFGGAFRTLFGGMSWITQGLMGALLLWMGVNARDRSIALAFLATGGVLVFLATNVHA

SEQ ID NO: 117 - protein, 696 aa, Artificial Sequence; identical to SEQ ID NO: 114
  Synthetic

SEQ ID NO: 118 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSA

SEQ ID NO: 119 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALVAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSA

SEQ ID NO: 120 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALVAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSA

SEQ ID NO: 121 - protein, 696 aa, Artificial Sequence
  Synthetic
MPMGSLQPLATLYLLGMLVASVLAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTLGKAFSTTLKGAQRLAALGDTAWDFGSIGGVFNSIGKAVHQVFGGAFRTLFGGMSWITQGLMGALLLWMGVNARDRSIALAFLATGGVLVFLATNVHA

SEQ ID NO: 122 - protein, 696 aa, Artificial Sequence
  Synthetic
MPMGSLQPLATLYLLGMLVASVLAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 123 - protein, 696 aa, Artificial Sequence
  Synthetic
MPMGSLQPLATLYLLGMLVASVLAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEVEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 124 - protein, 696 aa, Artificial Sequence; identical to SEQ ID NO: 122
  Synthetic

SEQ ID NO: 125 - protein, 696 aa, Artificial Sequence; identical to SEQ ID NO: 72
  Synthetic

SEQ ID NO: 126 - protein, 696 aa, Artificial Sequence
  Synthetic
MGKRSAGSIMWLASLAVVIACAGAAEVTRRGSAYYMYLDRNDAGEVISFPTTLGMNKCYIQIMDLGHMCDATMSYECPMLDEGVEPDDVDCWCNTSSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 127 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGERRRRRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 128 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEKRRKRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 129 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRARRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 130 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARGSGGAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 131 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEASRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 132 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEAARSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 133 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGESSRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 134 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGESARSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 135 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGSGSGSGSGSGSSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 136 - protein, 693 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGSGSGSGSGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 137 - protein, 690 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGSGSGSSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 138 - protein, 687 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGSGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 139 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGNGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 140 - protein, 696 aa, Artificial Sequence; identical to SEQ ID NO: 113
  Synthetic

SEQ ID NO: 141 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLQLKGTTYGVCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 142 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFTTTLKGAQRLAALGDTAWDFGSVGGVFTSVGKAVHQVFGAAFKSLFGGMSWFSQILIGTLLMWLGLNTKNGSISLMCLALGGVLIFLSTAVSA

SEQ ID NO: 143 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSSIGKAFTTTLKGAQRLAALGDTAWDFGSVGGVFTSVGKAVHQVFGGAFRSLFGGMSWITQGLLGALLLWMGINARDRSIALTFLAVGGVLLFLSVNVHA

SEQ ID NO: 144 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTLGKAFSTTLKGAQRLAALGDTAWDFGSIGGVFNSIGRAVHQVFGGAFRTLFGGMSWITQGLMGALLLWMGVNARDRSIALAFLATGGVLVFLATNVHA

SEQ ID NO: 145 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSSIGKAFTTTLKGAQRLAALGDTAWDFGSVGGVFTSVGKAVHQVFGGAFRSLFGGMSWFSQILIGTLLMWLGLNTKNGSISLMCLALGGVLIFLSTAVSA

SEQ ID NO: 146 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTLGKAFSTTLKGAQRLAALGDTAWDFGSIGGVFNSIGRAVHQVFGGAFRTLFGGMSWFSQILIGTLLMWLGLNTKNGSISLMCLALGGVLIFLSTAVSA

SEQ ID NO: 147 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSSIGKAFTTTLKGAQRLAALGDTAWDFGSVGGVFTSVGKAVHQIFGAAFKSLFGGMSWFSQILIGTLLMWLGLNTKNGSISLMCLALGGVLIFLSTAVSA

SEQ ID NO: 148 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTLGKAFSTTLKGAQRLAALGDTAWDFGSIGGVFNSIGRAVHQIFGAAFKSLFGGMSWFSQILIGTLLMWLGLNTKNGSISLMCLALGGVLIFLSTAVSA

SEQ ID NO: 149 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTLGKAFEATVRGAKRLAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 150 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEANISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 151 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDNASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 152 - protein, 696 aa, Artificial Sequence
  Synthetic
MGKRSAGSIMWLASLAVVIACAGAAEVTRRGSAYYMYLDRNDAGEVISFPTTLGMNKCYIQIMDLGHMCDATMSYECPMLDEGVEPDDVDCWCNTSSTWVVYGTCHHKKGEARRARRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDNASDSRCPTQGEAYLDKQSDTQYVCKRTLVDRGSGSGSGSGSGSSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEVEMDGAKGRLSSGHLKCRLKMDKLQLKGTTYGVCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTLGKAFSTTLKGAQRLAALGDTAWDFGSIGGVFNSIGRAVHQVFGGAFRTLFGGMSWITQGLMGALLLWMGVNARDRSIALAFLATGGVLVFLATNVHA

SEQ ID NO: 153 - protein, 696 aa, Artificial Sequence
  Synthetic
MGKRSAGSIMWLASLAVVIACAGAAEVTRRGSAYYMYLDRNDAGEVISFPTTLGMNKCYIQIMDLGHMCDATMSYECPMLDEGVEPDDVDCWCNTSSTWVVYGTCHHKKGESSRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDNASDSRCPTQGEAYLDKQSDTQYVCKRTLVDRGSGSGSGSGSGSSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEVEMDGAKGRLSSGHLKCRLKMDKLQLKGTTYGVCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTLGKAFSTTLKGAQRLAALGDTAWDFGSIGGVFNSIGRAVHQVFGGAFRTLFGGMSWITQGLMGALLLWMGVNARDRSIALAFLATGGVLVFLATNVHA

SEQ ID NO: 154 - protein, 687 aa, Artificial Sequence
  Synthetic
MGKRSAGSIMWLASLAVVIACAGAAEVTRRGSAYYMYLDRNDAGEVISFPTTLGMNKCYIQIMDLGHMCDATMSYECPMLDEGVEPDDVDCWCNTSSTWVVYGTCHHKKGEARRARRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDNASDSRCPTQGEAYLDKQSDTQYVCKRTLVDRGSGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEVEMDGAKGRLSSGHLKCRLKMDKLQLKGTTYGVCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTLGKAFSTTLKGAQRLAALGDTAWDFGSIGGVFNSIGRAVHQVFGGAFRTLFGGMSWITQGLMGALLLWMGVNARDRSIALAFLATGGVLVFLATNVHA

SEQ ID NO: 155 - protein, 696 aa, Artificial Sequence
  Synthetic
MGKRSAGSIMWLASLAVVIACAGAAEVTRRGSAYYMYLDRNDAGEVISFPTTLGMNKCYIQIMDLGHMCDATMSYECPMLDEGVEPDDVDCWCNTSSTWVVYGTCHHKKGEARRARRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDNASDSRCPTQGEAYLDKQSDTQYVCKRTLVDRGSGSGSGSGSGSSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEVEMDGAKGRLSSGHLKCRLKMDKLQLKGTTYGVCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSSIGKAFTTTLKGAQRLAALGDTAWDFGSVGGVFTSVGKAVHQVFGGAFRSLFGGMSWITQGLLGALLLWMGINARDRSIALTFLAVGGVLLFLSVNVHA

SEQ ID NO: 156 - protein, 696 aa, Artificial Sequence
  Synthetic
MGKRSAGSIMWLASLAVVIACAGAAEVTRRGSAYYMYLDRNDAGEVISFPTTLGMNKCYIQIMDLGHMCDATMSYECPMLDEGVEPDDVDCWCNTSSTWVVYGTCHHKKGEARRARRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDNASDSRCPTQGEAYLDKQSDTQYVCKRTLVDRGWGNGCGLFGNGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEVEMDGAKGRLSSGHLKCRLKMDKLQLKGTTYGVCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTLGKAFSTTLKGAQRLAALGDTAWDFGSIGGVFNSIGRAVHQVFGGAFRTLFGGMSWITQGLMGALLLWMGVNARDRSIALAFLATGGVLVFLATNVHA

SEQ ID NO: 157 - protein, 696 aa, Artificial Sequence
  Synthetic
MGKRSAGSIMWLASLAVVIACAGAAEVTRRGSAYYMYLDRNDAGEVISFPTTLGMNKCYIQIMDLGHMCDATMSYECPMLDEGVEPDDVDCWCNTSSTWVVYGTCHHKKGEARRARRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDNASDSRCPTQGEAYLDKQSDTQYVCKRTLVDRGSGSGSGSGSGSSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEVEMDGAKGRLSSGHLKCRLKMDKLQLKGTTYGVCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSSIGKAFTTTLKGAQRLAALGDTAWDFGSVGGVFTSVGKAVHQIFGAAFKSLFGGMSWFSQILIGTLLMWLGLNTKNGSISLMCLALGGVLIFLSTAVSA

SEQ ID NO: 158 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRARRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGSGSGSGSGSGSSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 159 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRARRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTLGKAFSTTLKGAQRLAALGDTAWDFGSIGGVFNSIGRAVHQVFGGAFRTLFGGMSWITQGLMGALLLWMGVNARDRSIALAFLATGGVLVFLATNVHA

SEQ ID NO: 160 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRARRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDNASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 161 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGSGSGSGSGSGSSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLQLKGTTYGVCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 162 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGSGSGSGSGSGSSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTLGKAFSTTLKGAQRLAALGDTAWDFGSIGGVFNSIGRAVHQVFGGAFRTLFGGMSWITQGLMGALLLWMGVNARDRSIALAFLATGGVLVFLATNVHA

SEQ ID NO: 163 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDNASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTLGKAFSTTLKGAQRLAALGDTAWDFGSIGGVFNSIGRAVHQVFGGAFRTLFGGMSWITQGLMGALLLWMGVNARDRSIALAFLATGGVLVFLATNVHA

SEQ ID NO: 164 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLQLKGTTYGVCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTLGKAFSTTLKGAQRLAALGDTAWDFGSIGGVFNSIGRAVHQVFGGAFRTLFGGMSWITQGLMGALLLWMGVNARDRSIALAFLATGGVLVFLATNVHA

SEQ ID NO: 165 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEVEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTLGKAFSTTLKGAQRLAALGDTAWDFGSIGGVFNSIGRAVHQVFGGAFRTLFGGMSWITQGLMGALLLWMGVNARDRSIALAFLATGGVLVFLATNVHA

SEQ ID NO: 166 - protein, 696 aa, Artificial Sequence; identical to SEQ ID NO: 118
  Synthetic

SEQ ID NO: 167 - protein, 696 aa, Artificial Sequence; identical to SEQ ID NO: 119
  Synthetic

SEQ ID NO: 168 - protein, 696 aa, Artificial Sequence; identical to SEQ ID NO: 144
  Synthetic

SEQ ID NO: 169 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCRLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 170 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGDFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 171 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCRDFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 172 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPAGGEAYLDKQSDTQYVCKRTLVDRGRGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 173 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPAGGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 174 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPAGGEAYLDKQSDTQYVCKRTLVDRGRGNGCRDFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 175 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGRGNGCRDFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 176 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPAQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 177 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTGGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 178 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGRGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 179 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAARQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 180 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRATVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 181 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVATALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 182 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQAGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 183 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTAVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 184 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVAVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 185 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVALGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 186 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSAEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 187 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMAKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 188 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDALRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 189 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRAKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 190 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVAYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 191 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSASLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 192 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSACTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 193 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIACIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 194 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIAVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 195 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSARDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 196 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMAGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 197 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHAGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 198 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMGEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 199 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSATQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 200 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPEALEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 201 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEIAPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 202 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAAATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 203 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHEADENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 204 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPATGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 205 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIALPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 206 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPAHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 207 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADAGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 208 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTAIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 209 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAATLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 210 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHARRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 211 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRETVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 212 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQQGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 213 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTIVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 214 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVIVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 215 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVILGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 216 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSEEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 217 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMNKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 218 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDRLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 219 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRIKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 220 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVTYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 221 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSFSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 222 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSICTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 223 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIKCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 224 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCISVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 225 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSDRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 226 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMTGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 227 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHSGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 228 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMSEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 229 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSNTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 230 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPEDLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 231 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEISPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 232 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAQATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 233 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHESDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 234 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPKTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 235 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIGLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 236 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPFHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 237 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADSGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 238 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTRIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 239 - protein, 696 aa, Artificial Sequence
  Synthetic
MGKRSAGSIMWLASLAVVIACAGAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAQTLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 240 - DNA, 2082 bp, Artificial Sequence
  Synthetic
atgggcaagcggtccgccggctctatcatgtggctggcctctctggccgtggtcatcgcatgcgcaggagcaaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 241 - DNA, 2067 bp, Artificial Sequence
  Synthetic
atgggctggagctgcatcatcctgtttctggtggcaacagcaaccggagtgcacagcaccaggagaggctccgcctactatatgtacctggaccggaatgatgccggcgaggccatctccttccccaccacactgggcatgaacaagtgttacatccagatcatggacctgggccacatgtgcgatgccaccatgtcttatgagtgtccaatgctggacgagggcgtggagcccgacgatgtggattgctggtgtaataccacatctacatgggtggtgtacggcacctgccaccacaagaagggagaggcaaggcgcagccggagagcagtgacactgccttcccactctacccggaagctgcagacaagatctcagacctggctggagagcagggagtatacaaagcacctgatccgggtggagaactggatctttagaaatccaggattcgcactggcagcagcagcaatcgcctggctgctgggcagctccacctctcagaaagtgatctacctggtcatgatcctgctgatcgcccctgcctattccatcaggtgcatcggcgtgtctaatcgcgactttgtggagggaatgtccggaggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagagcgatacacagtacgtgtgcaagaggaccctggtggacaggggatggggaaatggatgtggcctgtttggcaagggctccctggtgacatgcgccaagttcgcctgttctaagaagatgaccggcaagagcatccagccagagaacctggagtacaggatcatgctgagcgtgcacggctcccagcactctggcatgatcgtgaacgacacaggccacgagacagatgagaatagggccaaggtggagatcacacctaacagcccacgcgccgaggccaccctgggaggatttggctccctgggcctggactgcgagcctaggacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggccggctgatcaccgcaaatccagtgatcacagagtctaccgagaacagcaagatgatgctggagctggacccccctttcggcgatagctatatcgtgatcggcgtgggcgagaagaagatcacacaccactggcacagaagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgagctggttttcccagatcctgatcggcacactgctgatgtggctgggcctgaacaccaagaatggctctatcagcctgatgtgcctggccctgggaggcgtgctgatcttcctgtccaccgccgtgtctgcctga

SEQ ID NO: 242 - DNA, 2013 bp, Artificial Sequence
  Synthetic
atgacccggagaggcagcgcctactatatgtacctggaccggaatgatgccggcgaggccatctcctttcccaccacactgggcatgaacaagtgctacatccagatcatggacctgggccacatgtgcgatgccaccatgagctatgagtgtccaatgctggacgagggcgtggagcccgacgatgtggattgctggtgtaataccacatctacatgggtggtgtacggcacctgtcaccacaagaagggagaggcaaggcgcagccggagagcagtgacactgccttcccactctacccggaagctgcagacaagaagccagacctggctggagtccagggagtatacaaagcacctgatccgggtggagaactggatctttagaaatccaggattcgcactggcagcagcagcaatcgcatggctgctgggcagctccaccagccagaaagtgatctacctggtcatgatcctgctgatcgcccctgcctattctatcaggtgcatcggcgtgagcaatagggacttcgtggagggaatgtccggaggcacctgggtggatgtggtgctggagcacggcggctgcgtgacagtgatggcccaggacaagccaaccgtggacatcgagctggtgaccacaaccgtgtccaacatggccgaggtgcggtcttactgctatgaggccagcatctccgacatggcctctgatagcagatgtcccacccagggcgaggcctacctggacaagcagtccgatacacagtacgtgtgcaagaggaccctggtggacaggggatggggaaatggatgtggcctgtttggcaagggctctctggtgacatgcgccaagttcgcctgtagcaagaagatgaccggcaagtccatccagccagagaacctggagtacaggatcatgctgtctgtgcacggctcccagcactctggcatgatcgtgaacgacacaggccacgagacagatgagaatagggccaaggtggagatcacacctaactccccacgcgccgaggccaccctgggaggatttggctctctgggcctggactgcgagcctaggacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggccggctgatcaccgcaaatccagtgatcacagagtctaccgagaacagcaagatgatgctggagctggaccccccttttggcgatagctatatcgtgatcggcgtgggcgagaagaagatcacacaccactggcacagaagcggctccacaatcggcaaggcctttgaggccaccgtgaggggagcaaagaggatggccgtgctgggcgacaccgcatgggatttcggctctgtgggaggcgccctgaacagcctgggcaagggcatccaccagatcttcggcgccgcctttaagtccctgttcggcggcatgagctggttttcccagatcctgatcggcacactgctgatgtggctgggcctgaacaccaagaatggctctatcagcctgatgtgcctggccctgggaggcgtgctgatcttcctgtccaccgccgtgtctgcctga

SEQ ID NO: 243 - DNA, 1587 bp, Artificial Sequence
  Synthetic
atgggcaagcggtccgccggctctatcatgtggctggcctctctggccgtggtcatcgcatgcgcaggagcaatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 244 - DNA, 1572 bp, Artificial Sequence
  Synthetic
atgggctggagctgcatcatcctgtttctggtggcaacagcaaccggagtgcacagcatcaggtgcatcggcgtgtctaatcgcgactttgtggagggaatgtccggaggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagagcgatacacagtacgtgtgcaagaggaccctggtggacaggggatggggaaatggatgtggcctgtttggcaagggctccctggtgacatgcgccaagttcgcctgttctaagaagatgaccggcaagagcatccagccagagaacctggagtacaggatcatgctgagcgtgcacggctcccagcactctggcatgatcgtgaacgacacaggccacgagacagatgagaatagggccaaggtggagatcacacctaacagcccacgcgccgaggccaccctgggaggatttggctccctgggcctggactgcgagcctaggacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggccggctgatcaccgcaaatccagtgatcacagagtctaccgagaacagcaagatgatgctggagctggacccccctttcggcgatagctatatcgtgatcggcgtgggcgagaagaagatcacacaccactggcacagaagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgagctggttttcccagatcctgatcggcacactgctgatgtggctgggcctgaacaccaagaatggctctatcagcctgatgtgcctggccctgggaggcgtgctgatcttcctgtccaccgccgtgtctgcctga

SEQ ID NO: 245 - DNA, 1518 bp, Artificial Sequence
  Synthetic
atgatcaggtgcatcggcgtgagcaatagggacttcgtggagggaatgtccggaggcacctgggtggatgtggtgctggagcacggcggctgcgtgacagtgatggcccaggacaagccaaccgtggacatcgagctggtgaccacaaccgtgtccaacatggccgaggtgcggtcttactgctatgaggccagcatctccgacatggcctctgatagcagatgtcccacccagggcgaggcctacctggacaagcagtccgatacacagtacgtgtgcaagaggaccctggtggacaggggatggggaaatggatgtggcctgtttggcaagggctctctggtgacatgcgccaagttcgcctgtagcaagaagatgaccggcaagtccatccagccagagaacctggagtacaggatcatgctgtctgtgcacggctcccagcactctggcatgatcgtgaacgacacaggccacgagacagatgagaatagggccaaggtggagatcacacctaactccccacgcgccgaggccaccctgggaggatttggctctctgggcctggactgcgagcctaggacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggccggctgatcaccgcaaatccagtgatcacagagtctaccgagaacagcaagatgatgctggagctggaccccccttttggcgatagctatatcgtgatcggcgtgggcgagaagaagatcacacaccactggcacagaagcggctccacaatcggcaaggcctttgaggccaccgtgaggggagcaaagaggatggccgtgctgggcgacaccgcatgggatttcggctctgtgggaggcgccctgaacagcctgggcaagggcatccaccagatcttcggcgccgcctttaagtccctgttcggcggcatgagctggttttcccagatcctgatcggcacactgctgatgtggctgggcctgaacaccaagaatggctctatcagcctgatgtgcctggccctgggaggcgtgctgatcttcctgtccaccgccgtgtctgcctga

SEQ ID NO: 246 - DNA, 1608 bp, Artificial Sequence
  Synthetic
atgatcaggtgcatcggcgtgagcaatagggacttcgtggagggaatgtccggaggcacctgggtggatgtggtgctggagcacggcggctgcgtgacagtgatggcccaggacaagccaaccgtggacatcgagctggtgaccacaaccgtgtccaacatggccgaggtgcggtcttactgctatgaggccagcatctccgacatggcctctgatagcagatgtcccacccagggcgaggcctacctggacaagcagtccgatacacagtacgtgtgcaagaggaccctggtggacaggggatggggaaatggatgtggcctgtttggcaagggctctctggtgacatgcgccaagttcgcctgtagcaagaagatgaccggcaagtccatccagccagagaacctggagtacaggatcatgctgtctgtgcacggctcccagcactctggcatgatcgtgaacgacacaggccacgagacagatgagaatagggccaaggtggagatcacacctaactccccacgcgccgaggccaccctgggaggatttggctctctgggcctggactgcgagcctaggacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggccggctgatcaccgcaaatccagtgatcacagagtctaccgagaacagcaagatgatgctggagctggaccccccttttggcgatagctatatcgtgatcggcgtgggcgagaagaagatcacacaccactggcacagaagcggctccacaatcggcaaggcctttgaggccaccgtgaggggagcaaagaggatggccgtgctgggcgacaccgcatgggatttcggctctgtgggaggcgccctgaacagcctgggcaagggcatccaccagatcttcggcgccgcctttaagtccctgttcggcggcatgagctggttttcccagatcctgatcggcacactgctgatgtggctgggcctgaacaccaagaatggctctatcagcctgatgtgcctggccctgggaggcgtgctgatcttcctgtccaccgccgtgtctgccggcctgaacgacatcttcgaggcccagaagatcgagtggcacgagctggaggtgctgttccagggcccaggccaccaccaccaccaccactga

SEQ ID NO: 247 - DNA, 1374 bp, Artificial Sequence
  Synthetic
atgatcaggtgcatcggcgtgagcaatagggacttcgtggagggaatgtccggaggcacctgggtggatgtggtgctggagcacggcggctgcgtgacagtgatggcccaggacaagccaaccgtggacatcgagctggtgaccacaaccgtgtccaacatggccgaggtgcggtcttactgctatgaggccagcatctccgacatggcctctgatagcagatgtcccacccagggcgaggcctacctggacaagcagtccgatacacagtacgtgtgcaagaggaccctggtggacaggggatggggaaatggatgtggcctgtttggcaagggctctctggtgacatgcgccaagttcgcctgtagcaagaagatgaccggcaagtccatccagccagagaacctggagtacaggatcatgctgtctgtgcacggctcccagcactctggcatgatcgtgaacgacacaggccacgagacagatgagaatagggccaaggtggagatcacacctaactccccacgcgccgaggccaccctgggaggatttggctctctgggcctggactgcgagcctaggacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggccggctgatcaccgcaaatccagtgatcacagagtctaccgagaacagcaagatgatgctggagctggaccccccttttggcgatagctatatcgtgatcggcgtgggcgagaagaagatcacacaccactggcacagaagcggctccacaatcggcaaggcctttgaggccaccgtgaggggagcaaagaggatggccgtgctgggcgacaccgcatgggatttcggctctgtgggaggcgccctgaacagcctgggcaagggcatccaccagatcttcggcgccgcctttaagtccctgtga

SEQ ID NO: 248 - DNA, 1464 bp, Artificial Sequence
  Synthetic
atgatcaggtgcatcggcgtgagcaatagggacttcgtggagggaatgtccggaggcacctgggtggatgtggtgctggagcacggcggctgcgtgacagtgatggcccaggacaagccaaccgtggacatcgagctggtgaccacaaccgtgtccaacatggccgaggtgcggtcttactgctatgaggccagcatctccgacatggcctctgatagcagatgtcccacccagggcgaggcctacctggacaagcagtccgatacacagtacgtgtgcaagaggaccctggtggacaggggatggggaaatggatgtggcctgtttggcaagggctctctggtgacatgcgccaagttcgcctgtagcaagaagatgaccggcaagtccatccagccagagaacctggagtacaggatcatgctgtctgtgcacggctcccagcactctggcatgatcgtgaacgacacaggccacgagacagatgagaatagggccaaggtggagatcacacctaactccccacgcgccgaggccaccctgggaggatttggctctctgggcctggactgcgagcctaggacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggccggctgatcaccgcaaatccagtgatcacagagtctaccgagaacagcaagatgatgctggagctggaccccccttttggcgatagctatatcgtgatcggcgtgggcgagaagaagatcacacaccactggcacagaagcggctccacaatcggcaaggcctttgaggccaccgtgaggggagcaaagaggatggccgtgctgggcgacaccgcatgggatttcggctctgtgggaggcgccctgaacagcctgggcaagggcatccaccagatcttcggcgccgcctttaagtccctgggcctgaacgacatcttcgaggcccagaagatcgagtggcacgagctggaggtgctgttccagggcccaggccaccaccaccaccaccactga

SEQ ID NO: 249 - DNA, 1443 bp, Artificial Sequence
  Synthetic
atgggcaagcggtccgccggctctatcatgtggctggcctctctggccgtggtcatcgcatgcgcaggagcaatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgtga

SEQ ID NO: 250 - DNA, 1428 bp, Artificial Sequence
  Synthetic
atgggctggagctgcatcatcctgtttctggtggcaacagcaaccggagtgcacagcatcaggtgcatcggcgtgtctaatcgcgactttgtggagggaatgtccggaggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagagcgatacacagtacgtgtgcaagaggaccctggtggacaggggatggggaaatggatgtggcctgtttggcaagggctccctggtgacatgcgccaagttcgcctgttctaagaagatgaccggcaagagcatccagccagagaacctggagtacaggatcatgctgagcgtgcacggctcccagcactctggcatgatcgtgaacgacacaggccacgagacagatgagaatagggccaaggtggagatcacacctaacagcccacgcgccgaggccaccctgggaggatttggctccctgggcctggactgcgagcctaggacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggccggctgatcaccgcaaatccagtgatcacagagtctaccgagaacagcaagatgatgctggagctggacccccctttcggcgatagctatatcgtgatcggcgtgggcgagaagaagatcacacaccactggcacagaagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgtga

SEQ ID NO: 251 - DNA, 1563 bp, Artificial Sequence
  Synthetic
atgggcaagcggtccgccggctctatcatgtggctggcctctctggccgtggtcatcgcatgcgcaggagcaatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacggaagcggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 252 - DNA, 1587 bp, Artificial Sequence
  Synthetic
atgggcaagcggtccgccggctctatcatgtggctggcctctctggccgtggtcatcgcatgcgcaggagcaatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtgaaccagggcgccggcaatggctgcggcgccgccggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 253 - DNA, 1419 bp, Artificial Sequence
  Synthetic
atgggcaagcggtccgccggctctatcatgtggctggccagcctggcagtggtcatcgcatgcgcaggagcaatcaggtgtatcggcgtgagcaatagggacttcgtggagggaatgtccggaggaacctgggtggatgtggtgctggagcacggcggctgcgtgacagtgatggcccaggacaagcctaccgtggatatcgagctggtgaccacaaccgtgagcaacatggccgaggtgcggtcctactgctatgaggcctctatcagcgacatggcctccgatagccggtgtccaacccagggagaggcatacctggacaagcagtccgatacacagtacgtgtgcaagcggaccctggtggacggctctggcaagggcagcctggtgacatgcgccaagtttgcctgttctaagaagatgaccggcaagagcatccagcctgagaatctggagtacagaatcatgctgtctgtgcacggcagccagcactccggcatgatcgtgaacgacacaggccacgagacagatgagaatagggccaaggtggagatcacacctaactctccaagggcagaggccaccctgggaggattcggcagcctgggcctggactgcgagccaaggacaggcctggactttagcgatctgtactatctgaccatgaacaataagcactggctggtgcacaaggagtggttccacgacatcccactgccatggcacgcaggagcagatacaggaacccctcactggaacaataaggaggccctggtggagtttaaggatgcccacgccaagaggcagacagtggtggtgctgggctcccaggagggagcagtgcacaccgccctggcaggcgccctggaggccgagatggacggagcaaagggccgcctgagctccggacacctgaagtgccggctgaagatggataagctgagactgaagggcgtgagctactccctgtgcacagccgccttcaccttcaccaagatcccagccgagacactgcacggcacagtgaccgtggaggtgcagtatgccggcacagacggcccctgtaaggtgcctgcccagatggccgtggatatgcagacactgaccccagtgggcaggctgatcaccgccaatcccgtgatcacagagtccaccgagaactctaagatgatgctggagctggacccccctttcggcgatagctatatcgtgatcggcgtgggcgagaagaagatcacacaccactggcaccgctctggcagcacaatcggcaaggccttcgaggcaaccgtgcggggagcaaagagaatggccgtgctgggcgacaccgcatgggattttggctccgtgggaggcgccctgaattctctgggcaagggcatccaccagatcttcggcgccgcctttaagtccctgtga

SEQ ID NO: 254 - DNA, 1443 bp, Artificial Sequence
  Synthetic
atgggcaagcggtccgccggctctatcatgtggctggccagcctggcagtggtcatcgcatgcgcaggagcaatcaggtgtatcggcgtgtccaatcgcgacttcgtggagggcatgtctggcggcacctgggtggatgtggtgctggagcacggcggctgcgtgacagtgatggcccaggacaagcctaccgtggatatcgagctggtgaccacaaccgtgtccaacatggccgaggtgcggtcttactgctatgaggcctctatcagcgacatggcctccgatagccggtgtccaacccagggagaggcatacctggacaagcagtctgatacacagtacgtgtgcaagcggaccctggtgaaccagggagcaggaaatggatgtggagcagcaggcaagggcagcctggtgacatgcgccaagtttgcctgtagcaagaagatgaccggcaagtccatccagcctgagaatctggagtacagaatcatgctgtccgtgcacggcagccagcactccggcatgatcgtgaacgacacaggccacgagacagatgagaatagggccaaggtggagatcacacctaacagcccaagggcagaggccaccctgggaggcttcggctccctgggcctggactgcgagccaaggacaggcctggacttttctgatctgtactatctgaccatgaacaataagcactggctggtgcacaaggagtggttccacgacatcccactgccatggcacgcaggagcagatacaggaacccctcactggaacaataaggaggccctggtggagtttaaggatgcccacgccaagaggcagacagtggtggtgctgggctcccaggagggagcagtgcacaccgccctggcaggcgccctggaggccgagatggacggagcaaagggccgcctgagctccggacacctgaagtgccggctgaagatggataagctgagactgaagggcgtgagctactccctgtgcacagccgccttcaccttcaccaagatcccagccgagacactgcacggcacagtgaccgtggaggtgcagtatgccggcacagacggcccctgtaaggtgcctgcccagatggccgtggatatgcagacactgaccccagtgggcaggctgatcaccgccaatcccgtgatcacagagtctaccgagaacagcaagatgatgctggagctggacccccctttcggcgatagctatatcgtgatcggcgtgggcgagaagaagatcacacaccactggcaccgctctggcagcacaatcggcaaggccttcgaggcaaccgtgcggggagcaaagagaatggccgtgctgggcgacaccgcatgggattttggctctgtgggaggcgccctgaatagcctgggcaagggcatccaccagatcttcggcgccgcctttaagtccctgtga

SEQ ID NO: 255 - DNA, 1509 bp, Artificial Sequence
  Synthetic
atgggcaagcggtccgccggctctatcatgtggctggccagcctggcagtggtcatcgcatgcgcaggagcaatcaggtgtatcggcgtgagcaatagggacttcgtggagggaatgtccggaggaacctgggtggatgtggtgctggagcacggcggctgcgtgacagtgatggcccaggacaagcctaccgtggatatcgagctggtgaccacaaccgtgagcaacatggccgaggtgcggtcctactgctatgaggcctctatcagcgacatggcctccgatagccggtgtccaacccagggagaggcatacctggacaagcagtccgatacacagtacgtgtgcaagcggaccctggtggacggctctggcaagggcagcctggtgacatgcgccaagtttgcctgttctaagaagatgaccggcaagagcatccagcctgagaatctggagtacagaatcatgctgtctgtgcacggcagccagcactccggcatgatcgtgaacgacacaggccacgagacagatgagaatagggccaaggtggagatcacacctaactctccaagggcagaggccaccctgggaggattcggcagcctgggcctggactgcgagccaaggacaggcctggactttagcgatctgtactatctgaccatgaacaataagcactggctggtgcacaaggagtggttccacgacatcccactgccatggcacgcaggagcagatacaggaacccctcactggaacaataaggaggccctggtggagtttaaggatgcccacgccaagaggcagacagtggtggtgctgggctcccaggagggagcagtgcacaccgccctggcaggcgccctggaggccgagatggacggagcaaagggccgcctgagctccggacacctgaagtgccggctgaagatggataagctgagactgaagggcgtgagctactccctgtgcacagccgccttcaccttcaccaagatcccagccgagacactgcacggcacagtgaccgtggaggtgcagtatgccggcacagacggcccctgtaaggtgcctgcccagatggccgtggatatgcagacactgaccccagtgggcaggctgatcaccgccaatcccgtgatcacagagtccaccgagaactctaagatgatgctggagctggacccccctttcggcgatagctatatcgtgatcggcgtgggcgagaagaagatcacacaccactggcaccgctctggcagcacaatcggcaaggccttcgaggcaaccgtgcggggagcaaagagaatggccgtgctgggcgacaccgcatgggattttggctccgtgggaggcgccctgaattctctgggcaagggcatccaccagatcttcggcgccgcctttaagtccctgggcctgaacgatatcttcgaggcccagaagatcgagtggcacgagctggaggtgctgtttcagggccccggccaccaccaccaccaccactga

SEQ ID NO: 256 - DNA, 1533 bp, Artificial Sequence
  Synthetic
atgggcaagcggtccgccggctctatcatgtggctggccagcctggcagtggtcatcgcatgcgcaggagcaatcaggtgtatcggcgtgtccaatcgcgacttcgtggagggcatgtctggcggcacctgggtggatgtggtgctggagcacggcggctgcgtgacagtgatggcccaggacaagcctaccgtggatatcgagctggtgaccacaaccgtgtccaacatggccgaggtgcggtcttactgctatgaggcctctatcagcgacatggcctccgatagccggtgtccaacccagggagaggcatacctggacaagcagtctgatacacagtacgtgtgcaagcggaccctggtgaaccagggagcaggaaatggatgtggagcagcaggcaagggcagcctggtgacatgcgccaagtttgcctgtagcaagaagatgaccggcaagtccatccagcctgagaatctggagtacagaatcatgctgtccgtgcacggcagccagcactccggcatgatcgtgaacgacacaggccacgagacagatgagaatagggccaaggtggagatcacacctaacagcccaagggcagaggccaccctgggaggcttcggctccctgggcctggactgcgagccaaggacaggcctggacttttctgatctgtactatctgaccatgaacaataagcactggctggtgcacaaggagtggttccacgacatcccactgccatggcacgcaggagcagatacaggaacccctcactggaacaataaggaggccctggtggagtttaaggatgcccacgccaagaggcagacagtggtggtgctgggctcccaggagggagcagtgcacaccgccctggcaggcgccctggaggccgagatggacggagcaaagggccgcctgagctccggacacctgaagtgccggctgaagatggataagctgagactgaagggcgtgagctactccctgtgcacagccgccttcaccttcaccaagatcccagccgagacactgcacggcacagtgaccgtggaggtgcagtatgccggcacagacggcccctgtaaggtgcctgcccagatggccgtggatatgcagacactgaccccagtgggcaggctgatcaccgccaatcccgtgatcacagagtctaccgagaacagcaagatgatgctggagctggacccccctttcggcgatagctatatcgtgatcggcgtgggcgagaagaagatcacacaccactggcaccgctctggcagcacaatcggcaaggccttcgaggcaaccgtgcggggagcaaagagaatggccgtgctgggcgacaccgcatgggattttggctctgtgggaggcgccctgaatagcctgggcaagggcatccaccagatcttcggcgccgcctttaagtccctgggcctgaacgacatcttcgaggcccagaagatcgagtggcacgagctggaggtgctgtttcagggccccggccaccaccaccaccaccactga

SEQ ID NO: 257 - DNA, 2082 bp, Artificial Sequence
  Synthetic
atgggcaagcggtccgccggctctatcatgtggctggcctctctggccgtggtcatcgcatgcgcaggagcaaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagagcgtaggcgccgtcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 258 - DNA, 2082 bp, Artificial Sequence
  Synthetic
atgggcaagcggtccgccggctctatcatgtggctggcctctctggccgtggtcatcgcatgcgcaggagcaaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagagcgtaggcgcaaacggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 259 - DNA, 2058 bp, Artificial Sequence
  Synthetic
atgggcaagcggtccgccggctctatcatgtggctggcctctctggccgtggtcatcgcatgcgcaggagcaaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacggatcgggaaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 260 - DNA, 2082 bp, Artificial Sequence
  Synthetic
atgggcaagcggtccgccggctctatcatgtggctggcctctctggccgtggtcatcgcatgcgcaggagcaaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtgaaccagggagcgggaaatggatgtggcgcggcgggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 261 - DNA, 2058 bp, Artificial Sequence
  Synthetic
atgggcaagcggtccgccggctctatcatgtggctggcctctctggccgtggtcatcgcatgcgcaggagcaaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagagcgtaggcgccgtcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacggatcgggaaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 262 - DNA, 2058 bp, Artificial Sequence
  Synthetic
atgggcaagcggtccgccggctctatcatgtggctggcctctctggccgtggtcatcgcatgcgcaggagcaaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagagcgtaggcgcaaacggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacggatcgggaaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 263 - DNA, 2082 bp, Artificial Sequence
  Synthetic
atgggcaagcggtccgccggctctatcatgtggctggcctctctggccgtggtcatcgcatgcgcaggagcaaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagagcgtaggcgccgtcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtgaaccagggagcgggaaatggatgtggcgcggcgggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 264 - DNA, 2082 bp, Artificial Sequence
  Synthetic
atgggcaagcggtccgccggctctatcatgtggctggcctctctggccgtggtcatcgcatgcgcaggagcaaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagagcgtaggcgcaaacggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtgaaccagggagcgggaaatggatgtggcgcggcgggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 265 - DNA, 1914 bp, Artificial Sequence
  Synthetic
atgggcaagcggtccgccggctctatcatgtggctggcctctctggccgtggtcatcgcatgcgcaggagcaaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagagcgtaggcgccgtcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacggatcgggaaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgtga

SEQ ID NO: 266 - DNA, 1914 bp, Artificial Sequence
  Synthetic
atgggcaagcggtccgccggctctatcatgtggctggcctctctggccgtggtcatcgcatgcgcaggagcaaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagagcgtaggcgcaaacggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacggatcgggaaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgtga

SEQ ID NO: 267 - DNA, 1938 bp, Artificial Sequence
  Synthetic
atgggcaagcggtccgccggctctatcatgtggctggcctctctggccgtggtcatcgcatgcgcaggagcaaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagagcgtaggcgccgtcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtgaaccagggagcgggaaatggatgtggcgcggcgggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgtga

SEQ ID NO: 268 - DNA, 1938 bp, Artificial Sequence
  Synthetic
atgggcaagcggtccgccggctctatcatgtggctggcctctctggccgtggtcatcgcatgcgcaggagcaaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagagcgtaggcgcaaacggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtgaaccagggagcgggaaatggatgtggcgcggcgggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgtga

SEQ ID NO: 269 - DNA, 2082 bp, Artificial Sequence
  Synthetic
atgggcaagcggtccgccggctctatcatgtggctggcctctctggccgtggtcatcgcatgcgcaggagcaaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccagcatcggcaaggcctttaccaccaccctgaagggagcacagaggctggccgccctgggcgacaccgcatgggatttcggctccgtgggaggcgtgttcacctctgtgggcaaggccgtgcaccaggtgttcggcggcgcctttcggtccctgttcggcggcatgtcttggatcacccagggcctgctgggcgccctgctgctgtggatgggcatcaacgcccgggaccggtctatcgccctgaccttcctggccgtgggaggcgtgctgctgttcctgagcgtgaacgtgcacgcctga

SEQ ID NO: 270 - DNA, 2082 bp, Artificial Sequence
  Synthetic
atgggcaagcggtccgccggctctatcatgtggctggcctctctggccgtggtcatcgcatgcgcaggagcaaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccaccctgggcaaggcctttagcaccaccctgaagggagcacagaggctggccgccctgggcgacaccgcatgggatttcggctccatcggaggcgtgttcaactctatcggcaaggccgtgcaccaggtgttcggcggcgcctttcggaccctgttcggcggcatgtcttggatcacccagggcctgatgggcgccctgctgctgtggatgggcgtgaacgcccgggaccggtctatcgccctggccttcctggccaccggaggcgtgctggtgttcctggccaccaacgtgcacgcctga

SEQ ID NO: 271 - DNA, 1587 bp, Artificial Sequence
  Synthetic
atgggcaagcggtccgccggctctatcatgtggctggcctctctggccgtggtcatcgcatgcgcaggagcaatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccagcatcggcaaggcctttaccaccaccctgaagggagcacagaggctggccgccctgggcgacaccgcatgggatttcggctccgtgggaggcgtgttcacctctgtgggcaaggccgtgcaccaggtgttcggcggcgcctttcggtccctgttcggcggcatgtcttggatcacccagggcctgctgggcgccctgctgctgtggatgggcatcaacgcccgggaccggtctatcgccctgaccttcctggccgtgggaggcgtgctgctgttcctgagcgtgaacgtgcacgcctga

SEQ ID NO: 272 - DNA, 1587 bp, Artificial Sequence
  Synthetic
atgggcaagcggtccgccggctctatcatgtggctggcctctctggccgtggtcatcgcatgcgcaggagcaatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccaccctgggcaaggcctttagcaccaccctgaagggagcacagaggctggccgccctgggcgacaccgcatgggatttcggctccatcggaggcgtgttcaactctatcggcaaggccgtgcaccaggtgttcggcggcgcctttcggaccctgttcggcggcatgtcttggatcacccagggcctgatgggcgccctgctgctgtggatgggcgtgaacgcccgggaccggtctatcgccctggccttcctggccaccggaggcgtgctggtgttcctggccaccaacgtgcacgcctga

SEQ ID NO: 273 - DNA, 2082 bp, Artificial Sequence
  Synthetic
atgggcaagcggtccgccggctctatcatgtggctggcctctctggccgtggtcatcgcatgcgcaggagcaaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccagcatcggcaagatgtttgagagcacctacaggggagcaaagaggatggccatcctgggcgagaccgcatgggatttcggctccgtgggaggcctgctgacctctctgggcaaggccgtgcaccaggtgttcggcagcgtgtacaccaccatgttcggcggcgtgtcttggatggtgcggatcctgatcggcctgctggtgctgtggatcggcaccaacagccggaatacctctatggccatgagctgcatcgccgtgggaggcatcaccctgttcctgggcttcaccgtgcacgcctga

SEQ ID NO: 274 - DNA, 1584 bp, Artificial Sequence
  Synthetic
ggcaagcggtccgccggctctatcatgtggctggcctctctggccgtggtcatcgcatgcgcaggagcaatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccagcatcggcaagatgtttgagagcacctacaggggagcaaagaggatggccatcctgggcgagaccgcatgggatttcggctccgtgggaggcctgctgacctctctgggcaaggccgtgcaccaggtgttcggcagcgtgtacaccaccatgttcggcggcgtgtcttggatggtgagaatcctgatcggcctgctggtgctgtggatcggcaccaacagccggaatacctctatggccatgagctgcatcgccgtgggaggcatcaccctgttcctgggcttcaccgtgcacgcctga

SEQ ID NO: 275 - DNA, 1833 bp, Artificial Sequence
  Synthetic
atgggcaagcggagcgccggctccatcatgtggctggcatccctggcagtggtcatcgcatgcgcaggagcattccacctgaccacaaggggcggcgagcctcacatgatcgtgtctaagcaggagcgcggcaagtctctgctgtttaagacaagcgccggcgtgaatatgtgcaccctgatcgccatggacctgggcgagctgtgcgaggataccatgacatacaagtgtccaaggatcaccgaggccgagcccgacgatgtggactgctggtgtaacgccaccgatacatgggtgacctatggcacatgctctcagaccggagagcacaggagagacaagcggagcgtggccctggcaccacacgtgggcctgggcctggagacaagagccgagacatggatgagctccgagggcgcctggaagcagatccagaaggtggagacatgggcactgaggcacccaggcttcaccgtgatcgccctgtttctggcccacgccatcggcacctccatcacacagaagggcatcatcttcatcctgctgatgctggtgaccccctctatggccatgcggtgcgtgggcatcggcaatagagactttgtggagggcctgtccggagcaacatgggtggatgtggtgctggagcacggctcttgcgtgaccacaatggccaagaacaagcccaccctggacatcgagctgctgaagaccgaggtgacaaatcctgccgtgctgaggaagctgtgcatcgaggccaagatctccaacaccacaaccgattctcgctgtccaacacagggagaggccaccctggtggaggagcaggacgccaacttcgtgtgcaggcgcacctttgtggatcggggctggggcaatggctgtggcctgttcggcaagggcagcctgatcacatgcgccaagtttaagtgcgtgaccaagctggagggcaagatcgtgcagtacgagaatctgaagtattccgtgatcgtgaccgtgcacacaggcgaccagcaccaagtgggcaacgagacaaccgagcacggcacaaccgccaccatcacacctcaggccccaacatctgagatccagctgaccgactacggcaccctgacactggattgcagccctcggacaggcctggatttcaatgagatggtgctgctgaccatgaaggagagaagctggctggtgcacaagcagtggtttctggacctgccactgccatggacctccggagcctccacatctcaggagacatggaacaggcaggatctgctggtgaccttcaagacagcccacgccaagaagcaggaggtggtggtgctgggctctcaggagggagcaatgcacaccgccctgacaggagccaccgagatccagaccagcggcacaaccacaatcttcgccggccacctgaagtgccgcctgaagatggataagctgacactgaagggcatgagctacgtgatgtgcaccggctcctttaagctggagaaggaggtggccgagacacagcacggcaccgtgctggtgcaggtgaagtatgagggcaccgacgccccctgtaagatcccttttagcacacaggatgagaagggagcaacccagaacggccggctgatcacagccaatcctatcgtgaccgacaaggagaagccagtgaatatcgaggccgagccccctttcggcgagagctatatcgtggtgggagcaggagagaaggccctgaagctgtcctggtttaagaagggctctagcggcaagcctatcccaaaccccctgctgggcctggattccaccagaacaggccaccaccaccaccaccactga

SEQ ID NO: 276 - DNA, 1833 bp, Artificial Sequence
  Synthetic
atgggcaagaggagcgccggctccatcatgtggctggcaagcctggcagtggtcatcgcatgcgcaggagcattccacctgaccacaaggaacggcgagcctcacatgatcgtgtcccgccaggagaagggcaagtctctgctgtttaagaccgaggacggcgtgaatatgtgcacactgatggccatggacctgggcgagctgtgcgaggataccatcacatacaagtgtccattcctgaagcagaacgagcccgaggacatcgattgctggtgtaattctaccagcacatgggtgacatatggaacctgcaccacaaccggagagcacaggagagagaagaggtccgtggccctggtgccacacgtgggaatgggcctggagacacgcacagagacatggatgagctccgagggagcatggaagcatgcacagaggatcgagacatggattctgcgccacccaggctttacaatcatggccgccatcctggcctacaccatcggcacaacccacttccagcgggccctgatctttatcctgctgaccgcagtggcaccaagcatgacaatgcggtgcatcggcatctccaacagagacttcgtggagggcgtgtctggaggcagctgggtggatatcgtgctggagcacggctcctgcgtgacaaccatggccaagaataagccaaccctggactttgagctgatcaagaccgaggcaaagcagccagccacactgcggaagtattgcatcgaggccaagctgacaaacacaaccacagatagccggtgtccaacccagggagagcctagcctgaatgaggagcaggacaagcggttcgtgtgcaagcactctatggtggatagaggatggggaaacggatgtggcctgttcggcaagggcggcatcgtgacctgcgccatgtttacctgtaagaagaacatgaagggcaaggtggtgcagcccgagaatctggagtacaccatcgtgatcacacctcactctggagaggagcacgcagtgggaaatgacacaggcaagcacggcaaggagatcaagatcacccctcagtctagcatcaccgaggccgagctgacaggctatggcacagtgaccatggagtgcagcccaaggaccggcctggatttcaacgagatggtgctgctgcagatggagaataaggcctggctggtgcaccgccagtggtttctggacctgccactgccatggctgccaggagcagatacccagggcagcaactggattcagaaggagacactggtgaccttcaagaatcctcacgccaagaagcaggacgtggtggtgctgggctcccaggagggagcaatgcacacagccctgaccggagccacagagatccagatgtcctctggcaacctgctgttcaccggccacctgaagtgcaggctgcgcatggataagctgcagctgaagggcatgtcctactctatgtgcaccggcaagtttaaggtggtgaaggagatcgccgagacacagcacggcacaatcgtgatccgggtgcagtatgacggcgatggcagcccttgtaagatcccatttgagatcatggacctggagaagcggcacgtgctgggcagactgatcaccgtgaaccctatcgtgacagagaaggactccccagtgaatatcgaggccgagccccctttcggcgattcttacatcatcatcggcgtggagcccggccagctgaagctgaactggtttaagaagggcagctccggcaagcctatcccaaatcccctgctgggcctggattccacaagaaccggccaccaccaccaccaccactga

SEQ ID NO: 277 - DNA, 1854 bp, Artificial Sequence
  Synthetic
atgggcaagaggtctgccggcagcatcatgtggctggcctctctggcagtggtcatcgcatgcgcaggagcagtgaccctgagcaacttccagggcaaagtgatgatgacagtgaatgccaccgacgtgacagatgtgatcaccatcccaacagccgccggcaagaacctgtgcatcgtgagggccatggacgtgggctacatgtgcgacgataccatcacatatgagtgtcccgtgctgtccgccggcaatgatcctgaggacatcgattgctggtgtaccaagtctgccgtgtacgtgaggtatggccgctgcaccaagacaaggcactcccggagatctaggcgcagcctgaccgtgcagacacacggagagtctaccctggccaacaagaagggcgcctggatggacagcaccaaggccacaaggtacctggtgaagacagagtcctggattctgaggaacccaggatatgcactggtggcagccgtgatcggatggatgctgggctccaataccatgcagagggtggtgttcgtggtgctgctgctgctggtggcaccagcatacagcttcaactgcctgggcatgtccaatcgcgactttctggagggcgtgtctggagcaacctgggtggacctggtgctggagggcgattcttgcgtgaccatcatgagcaaggacaagcccacaatcgatgtgaagatgatgaacatggaggcagcaaatctggcagaggtgcggagctactgctatctggccacagtgtccgatctgtctaccaaggccgcctgtcctacaatgggcgaggcccacaacgacaagagagccgatccagccttcgtgtgcaggcagggagtggtggacagaggatggggcaatggctgtggcctgttcggcaagggcagcatcgatacctgcgccaagtttgcctgttccaccaaggccatcggccggacaatcctgaaggagaacatcaagtacgaggtggccatcttcgtgcacggaccaaccacagtggagagccacggcaattattccacacaagtgggagcaacccaggcaggcagattttctatcaccccagccgcccccagctacacactgaagctgggcgagtatggagaggtgaccgtggactgcgagcctcggagcggaatcgataccaatgcctactatgtgatgacagtgggcaccaagacattcctggtgcacagagagtggtttatggacctgaacctgccatggagctccgccggctccaccgtgtggcggaatagagagacactgatggagttcgaggagcctcacgccaccaagcagtccgtgatcgccctgggctctcaggagggcgccctgcaccaggccctggcaggagccatccctgtggagttttctagcaacaccgtgaagctgacaagcggccacctgaagtgccgggtgaagatggagaagctgcagtccaagggcaccacatacggcgtgtgctctaaggccttcaagtttctgggaaccccagcagatacaggacacggaaccgtggtgctggagctgcagtataccggcacagacggcccttgtaaggtgccaatctcctctgtggcctctctgaatgatctgaccccagtgggcagactggtgacagtgaaccccttcgtgagcgtggccaccgccaatgccaaggtgctgatcgagctggagcccccttttggcgactcctacatcgtggtgggcaggggcgagcagcagatcaaccaccactggcacaagagcggcagctccggcaagccaatccccaatcctctgctgggcctggattccaccaggacaggacaccaccaccaccaccactga

SEQ ID NO: 278 - DNA, 1866 bp, Artificial Sequence
  Synthetic
atgggcaagcggtctgccggcagcatcatgtggctggccagcctggccgtggtcatcgcatgcgcaggagcagcagaggtgacccggagaggcagcgcctactatatgtacctggacagaaatgatgccggcgaggccatctccttccccaccacactgggcatgaacaagtgttacatccagatcatggacctgggccacatgtgcgatgccaccatgtcctatgagtgtccaatgctggacgagggcgtggagcccgacgatgtggattgctggtgtaataccacatctacatgggtggtgtacggcacctgccaccacaagaagggagaggcaaggcgcagccggagagcagtgacactgccttcccactctaccaggaagctgcagacacgctctcagacctggctggagagccgggagtatacaaagcacctgatcagggtggagaactggatcttccgcaatcccggctttgcactggcagcagcagcaatcgcatggctgctgggcagctccaccagccagaaagtgatctacctggtcatgatcctgctgatcgcccctgcctattccatccggtgcatcggcgtgtctaatagagactttgtggagggaatgtccggaggaacctgggtggatgtggtgctggagcacggcggctgcgtgacagtgatggcccaggacaagccaaccgtggatatcgagctggtgaccacaaccgtgagcaacatggccgaggtgaggtcctactgctatgaggccagcatctccgacatggcctctgatagccgctgtccaacccagggagaggcatacctggacaagcagtccgatacacagtacgtgtgcaagcggaccctggtggacagaggctggggcaatggctgtggcctgttcggcaagggctctctggtgacatgcgccaagtttgcctgttctaagaagatgaccggcaagagcatccagccagagaacctggagtacaggatcatgctgagcgtgcacggctcccagcactctggcatgatcgtgaacgacacaggccacgagacagatgagaatcgggccaaggtggagatcacacctaactccccaagagcagaggccaccctgggaggattcggctctctgggcctggactgcgagcctaggacaggcctggacttttccgatctgtactatctgaccatgaacaataagcactggctggtgcacaaggagtggttccacgacatcccactgccatggcacgcaggagcagatacaggaaccccacactggaacaataaggaggccctggtggagtttaaggatgcccacgccaagaggcagacagtggtggtgctgggcagccaggagggagcagtgcacaccgccctggcaggcgccctggaggccgagatggacggagcaaagggccgcctgtctagcggccacctgaagtgcaggctgaagatggataagctgcgcctgaagggcgtgtcctactctctgtgcacagccgccttcaccttcaccaagatccccgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagagcaccgagaactccaagatgatgctggagctggacccccctttcggcgattcttatatcgtgatcggcgtgggcgagaagaagatcacacaccactggcaccggagcggctccaccggcaagcctatcccaaaccccctgctgggcctggactccacaagaaccggccaccaccaccaccaccactga

SEQ ID NO: 279 - DNA, 1833 bp, Artificial Sequence
  Synthetic
atgggcaagcggagcgccggctccatcatgtggctggcatccctggcagtggtcatcgcatgcgcaggagcattccacctgaccacaaggggcggcgagcctcacatgatcgtgtctaagcaggagcgcggcaagtctctgctgtttaagacaagcgccggcgtgaatatgtgcaccctgatcgccatggacctgggcgagctgtgcgaggataccatgacatacaagtgtccaaggatcaccgaggccgagcccgacgatgtggactgctggtgtaacgccaccgatacatgggtgacctatggcacatgctctcagaccggagagcacaggagagacaagcggagcgtggccctggcaccacacgtgggcctgggcctggagacaagagccgagacatggatgagctccgagggcgcctggaagcagatccagaaggtggagacatgggcactgaggcacccaggcttcaccgtgatcgccctgtttctggcccacgccatcggcacctccatcacacagaagggcatcatcttcatcctgctgatgctggtgaccccctctatggccatgcggtgcgtgggcatcggcaatagagactttgtggagggcctgtccggagcaacatgggtggatgtggtgctggagcacggctcttgcgtgaccacaatggccaagaacaagcccaccctggacatcgagctgctgaagaccgaggtgacaaatcctgccgtgctgaggaagctgtgcatcgaggccaagatctccaacaccacaaccgattctcgctgtccaacacagggagaggccaccctggtggaggagcaggacgccaacttcgtgtgcaggcgcacctttgtggatcggggccgtggcaatggctgtggcctgttcggcaagggcagcctgatcacatgcgccaagtttaagtgcgtgaccaagctggagggcaagatcgtgcagtacgagaatctgaagtattccgtgatcgtgaccgtgcacacaggcgaccagcaccaagtgggcaacgagacaaccgagcacggcacaaccgccaccatcacacctcaggccccaacatctgagatccagctgaccgactacggcaccctgacactggattgcagccctcggacaggcctggatttcaatgagatggtgctgctgaccatgaaggagagaagctggctggtgcacaagcagtggtttctggacctgccactgccatggacctccggagcctccacatctcaggagacatggaacaggcaggatctgctggtgaccttcaagacagcccacgccaagaagcaggaggtggtggtgctgggctctcaggagggagcaatgcacaccgccctgacaggagccaccgagatccagaccagcggcacaaccacaatcttcgccggccacctgaagtgccgcctgaagatggataagctgacactgaagggcatgagctacgtgatgtgcaccggctcctttaagctggagaaggaggtggccgagacacagcacggcaccgtgctggtgcaggtgaagtatgagggcaccgacgccccctgtaagatcccttttagcacacaggatgagaagggagcaacccagaacggccggctgatcacagccaatcctatcgtgaccgacaaggagaagccagtgaatatcgaggccgagccccctttcggcgagagctatatcgtggtgggagcaggagagaaggccctgaagctgtcctggtttaagaagggctctagcggcaagcctatcccaaaccccctgctgggcctggattccaccagaacaggccaccaccaccaccaccactga

SEQ ID NO: 280 - DNA, 1833 bp, Artificial Sequence
  Synthetic
atgggcaagaggagcgccggctccatcatgtggctggcaagcctggcagtggtcatcgcatgcgcaggagcattccacctgaccacaaggaacggcgagcctcacatgatcgtgtcccgccaggagaagggcaagtctctgctgtttaagaccgaggacggcgtgaatatgtgcacactgatggccatggacctgggcgagctgtgcgaggataccatcacatacaagtgtccattcctgaagcagaacgagcccgaggacatcgattgctggtgtaattctaccagcacatgggtgacatatggaacctgcaccacaaccggagagcacaggagagagaagaggtccgtggccctggtgccacacgtgggaatgggcctggagacacgcacagagacatggatgagctccgagggagcatggaagcatgcacagaggatcgagacatggattctgcgccacccaggctttacaatcatggccgccatcctggcctacaccatcggcacaacccacttccagcgggccctgatctttatcctgctgaccgcagtggcaccaagcatgacaatgcggtgcatcggcatctccaacagagacttcgtggagggcgtgtctggaggcagctgggtggatatcgtgctggagcacggctcctgcgtgacaaccatggccaagaataagccaaccctggactttgagctgatcaagaccgaggcaaagcagccagccacactgcggaagtattgcatcgaggccaagctgacaaacacaaccacagatagccggtgtccaacccagggagagcctagcctgaatgaggagcaggacaagcggttcgtgtgcaagcactctatggtggatagaggacgtggaaacggatgtggcctgttcggcaagggcggcatcgtgacctgcgccatgtttacctgtaagaagaacatgaagggcaaggtggtgcagcccgagaatctggagtacaccatcgtgatcacacctcactctggagaggagcacgcagtgggaaatgacacaggcaagcacggcaaggagatcaagatcacccctcagtctagcatcaccgaggccgagctgacaggctatggcacagtgaccatggagtgcagcccaaggaccggcctggatttcaacgagatggtgctgctgcagatggagaataaggcctggctggtgcaccgccagtggtttctggacctgccactgccatggctgccaggagcagatacccagggcagcaactggattcagaaggagacactggtgaccttcaagaatcctcacgccaagaagcaggacgtggtggtgctgggctcccaggagggagcaatgcacacagccctgaccggagccacagagatccagatgtcctctggcaacctgctgttcaccggccacctgaagtgcaggctgcgcatggataagctgcagctgaagggcatgtcctactctatgtgcaccggcaagtttaaggtggtgaaggagatcgccgagacacagcacggcacaatcgtgatccgggtgcagtatgacggcgatggcagcccttgtaagatcccatttgagatcatggacctggagaagcggcacgtgctgggcagactgatcaccgtgaaccctatcgtgacagagaaggactccccagtgaatatcgaggccgagccccctttcggcgattcttacatcatcatcggcgtggagcccggccagctgaagctgaactggtttaagaagggcagctccggcaagcctatcccaaatcccctgctgggcctggattccacaagaaccggccaccaccaccaccaccactga

SEQ ID NO: 281 - DNA, 1854 bp, Artificial Sequence
  Synthetic
atgggcaagaggtctgccggcagcatcatgtggctggcctctctggcagtggtcatcgcatgcgcaggagcagtgaccctgagcaacttccagggcaaagtgatgatgacagtgaatgccaccgacgtgacagatgtgatcaccatcccaacagccgccggcaagaacctgtgcatcgtgagggccatggacgtgggctacatgtgcgacgataccatcacatatgagtgtcccgtgctgtccgccggcaatgatcctgaggacatcgattgctggtgtaccaagtctgccgtgtacgtgaggtatggccgctgcaccaagacaaggcactcccggagatctaggcgcagcctgaccgtgcagacacacggagagtctaccctggccaacaagaagggcgcctggatggacagcaccaaggccacaaggtacctggtgaagacagagtcctggattctgaggaacccaggatatgcactggtggcagccgtgatcggatggatgctgggctccaataccatgcagagggtggtgttcgtggtgctgctgctgctggtggcaccagcatacagcttcaactgcctgggcatgtccaatcgcgactttctggagggcgtgtctggagcaacctgggtggacctggtgctggagggcgattcttgcgtgaccatcatgagcaaggacaagcccacaatcgatgtgaagatgatgaacatggaggcagcaaatctggcagaggtgcggagctactgctatctggccacagtgtccgatctgtctaccaaggccgcctgtcctacaatgggcgaggcccacaacgacaagagagccgatccagccttcgtgtgcaggcagggagtggtggacagaggacgtggcaatggctgtggcctgttcggcaagggcagcatcgatacctgcgccaagtttgcctgttccaccaaggccatcggccggacaatcctgaaggagaacatcaagtacgaggtggccatcttcgtgcacggaccaaccacagtggagagccacggcaattattccacacaagtgggagcaacccaggcaggcagattttctatcaccccagccgcccccagctacacactgaagctgggcgagtatggagaggtgaccgtggactgcgagcctcggagcggaatcgataccaatgcctactatgtgatgacagtgggcaccaagacattcctggtgcacagagagtggtttatggacctgaacctgccatggagctccgccggctccaccgtgtggcggaatagagagacactgatggagttcgaggagcctcacgccaccaagcagtccgtgatcgccctgggctctcaggagggcgccctgcaccaggccctggcaggagccatccctgtggagttttctagcaacaccgtgaagctgacaagcggccacctgaagtgccgggtgaagatggagaagctgcagtccaagggcaccacatacggcgtgtgctctaaggccttcaagtttctgggaaccccagcagatacaggacacggaaccgtggtgctggagctgcagtataccggcacagacggcccttgtaaggtgccaatctcctctgtggcctctctgaatgatctgaccccagtgggcagactggtgacagtgaaccccttcgtgagcgtggccaccgccaatgccaaggtgctgatcgagctggagcccccttttggcgactcctacatcgtggtgggcaggggcgagcagcagatcaaccaccactggcacaagagcggcagctccggcaagccaatccccaatcctctgctgggcctggattccaccaggacaggacaccaccaccaccaccactga

SEQ ID NO: 282 - DNA, 1866 bp, Artificial Sequence
  Synthetic
atgggcaagcggtctgccggcagcatcatgtggctggccagcctggccgtggtcatcgcatgcgcaggagcagcagaggtgacccggagaggcagcgcctactatatgtacctggacagaaatgatgccggcgaggccatctccttccccaccacactgggcatgaacaagtgttacatccagatcatggacctgggccacatgtgcgatgccaccatgtcctatgagtgtccaatgctggacgagggcgtggagcccgacgatgtggattgctggtgtaataccacatctacatgggtggtgtacggcacctgccaccacaagaagggagaggcaaggcgcagccggagagcagtgacactgccttcccactctaccaggaagctgcagacacgctctcagacctggctggagagccgggagtatacaaagcacctgatcagggtggagaactggatcttccgcaatcccggctttgcactggcagcagcagcaatcgcatggctgctgggcagctccaccagccagaaagtgatctacctggtcatgatcctgctgatcgcccctgcctattccatccggtgcatcggcgtgtctaatagagactttgtggagggaatgtccggaggaacctgggtggatgtggtgctggagcacggcggctgcgtgacagtgatggcccaggacaagccaaccgtggatatcgagctggtgaccacaaccgtgagcaacatggccgaggtgaggtcctactgctatgaggccagcatctccgacatggcctctgatagccgctgtccaacccagggagaggcatacctggacaagcagtccgatacacagtacgtgtgcaagcggaccctggtggacagaggccgtggcaatggctgtggcctgttcggcaagggctctctggtgacatgcgccaagtttgcctgttctaagaagatgaccggcaagagcatccagccagagaacctggagtacaggatcatgctgagcgtgcacggctcccagcactctggcatgatcgtgaacgacacaggccacgagacagatgagaatcgggccaaggtggagatcacacctaactccccaagagcagaggccaccctgggaggattcggctctctgggcctggactgcgagcctaggacaggcctggacttttccgatctgtactatctgaccatgaacaataagcactggctggtgcacaaggagtggttccacgacatcccactgccatggcacgcaggagcagatacaggaaccccacactggaacaataaggaggccctggtggagtttaaggatgcccacgccaagaggcagacagtggtggtgctgggcagccaggagggagcagtgcacaccgccctggcaggcgccctggaggccgagatggacggagcaaagggccgcctgtctagcggccacctgaagtgcaggctgaagatggataagctgcgcctgaagggcgtgtcctactctctgtgcacagccgccttcaccttcaccaagatccccgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagagcaccgagaactccaagatgatgctggagctggacccccctttcggcgattcttatatcgtgatcggcgtgggcgagaagaagatcacacaccactggcaccggagcggctccaccggcaagcctatcccaaaccccctgctgggcctggactccacaagaaccggccaccaccaccaccaccactga

SEQ ID NO: 283 - DNA, 2091 bp, Artificial Sequence
  Synthetic
atgggcaagcggtccgccggctctatcatgtggctggcctctctggccgtggtcatcgcatgcgcaggagcagcggaggtcaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 284 - DNA, 2385 bp, Artificial Sequence
  Synthetic
atgaaaaacccaaagaagaaatccggaggattccggattgtcaatatgctaaaacgcggagtagcccgtgtaaaccccttgggaggtttgaagaggctgccagccggacttctgctgggtcatggacccatcagaatggttttggcaatactagcctttttgagatttacagcaatcaagccatcactgggcctcatcaacagatggggttctgtggggaaaaaagaggctatggaaataataaagaagtttaagaaagatcttgctgccatgttgagaataatcaatgctaggaaggagaggaagagacgtggtgcagacaccagcatcggaatcattggtctcctgctgactacagccatggcagcggagattaccagacgtggaagtgcatactacatgtacttggacaggagcgatgctgggaaggccatctcctttgctaccaacttgggagttaacaaatgccatgtacagatcatggatctcgggcacatgtgtgacgccaccatgagttatgagtgccctatgttggacgagggagtggaaccagatgatgtcgattgctggtgcaacacgacatcaacttgggttgtgtacggaacctgtcatcacaaaaaaggtgaagcacggcgatctagaagagctgtgacgctcccttctcactctacaaggaagttgcaaacgcggtcgcagacctggttagaatcaagagaatacacgaagcacctgatcaaggttgaaaactggatatttaggaaccccgggtttgcgctcgcagctgttgccattgcctggcttttgggaagctcgacgagccaaaaagtcatatacttggttatgatactgctgattgccccggcatacagcatcaggtgcattggagtcagcaatagagacttcgtggaaggcatgtcaggtgggacctgggttgatgtcgtcttggaacatggaggttgcgtcaccgttatggcacaggacaagccaacagttgacatagagttggtcacgacaacggttagtaacatggccgaggtaagatcctactgttatgaggcatcaatatcagacatggcttcggacagtcgctgcccaacacaaggtgaagcctaccttgataagcaatcagacacccaatatgtgtgcaaaagaacattggtggacagaggttggggaaatgggtgtggactttttggcaaagggagcctggtgacatgtgccaagttcacgtgttccaagaagatgactgggaagagcattcagccggagaatctggagtatcgaataatgctatcagtgcatggctcccagcacagcgggatgattgttaatgacataggacatgaaactgacgaaaacagagcgaaagtcgaggtcacgcccaattcaccaagagcagaagcaaccttgggaggctttggaagcttaggacttgattgtgaaccaaggacaggcctggacttttcagatttgtactacttgaccatgaacaacaagcactggttggtgcacaaagagtggtttcatgacatcccattgccttggcatgctggggcagataccggaactccacactggaacaacaaggaggcattggtagagttcaaagatgcccacgccaagaggcaaaccgtcgttgttctagggagccaggaaggagccgttcacacggctcttgctggagctctggaggctgagatggatggtgcaaaaggaaggctgttctccggccatttgaaatgccgcttaaaaatggacaagcttagattgaagggcgtgtcatattccttgtgcaccgcagcgttcacatttaccaaggtcccagctgaaacattgcatggaacagttacagtggaggtgcagtatgcagggacagatggaccctgcaaggtcccagcccagatggcggtggacatgcagaccctgaccccagtcgggaggctgataaccgccaaccctgtgattactgaaagcactgagaattcaaagatgatgttggagctcgacccaccatttggggattcttacattgtcataggagttggggacaagaaaatcacccatcactggcataggagtggtagcaccatcggaaaagcatttgaggccactgtgagaggtgccaagagaatggcagttctgggggatacagcctgggacttcggatcagtcgggggcgtgttcaactcattgggcaagggtgttcaccagatttttggagcagctttcaaatcactgtttggaggaatgtcctggttctcacagatcctcataggcacgctgctggtgtggttgggtttgaacacaaagaatggatccatctccctcacatgcttggccctggggggagtgatgatcttcctctccacggctgtctctgcttaa

SEQ ID NO: 285 - DNA, 2091 bp, Artificial Sequence
  Synthetic
atgggcaagaggtccgccggctcaatcatgtggctcgcgagcttggcagttgtcatagcttgtgcaggcgccgcggagattaccagacgtggaagtgcatactacatgtacttggacaggagcgatgctgggaaggccatctcctttgctaccaacttgggagttaacaaatgccatgtacagatcatggatctcgggcacatgtgtgacgccaccatgagttatgagtgccctatgttggacgagggagtggaaccagatgatgtcgattgctggtgcaacacgacatcaacttgggttgtgtacggaacctgtcatcacaaaaaaggtgaagcacggcgatctagaagagctgtgacgctcccttctcactctacaaggaagttgcaaacgcggtcgcagacctggttagaatcaagagaatacacgaagcacctgatcaaggttgaaaactggatatttaggaaccccgggtttgcgctcgcagctgttgccattgcctggcttttgggaagctcgacgagccaaaaagtcatatacttggttatgatactgctgattgccccggcatacagcatcaggtgcattggagtcagcaatagagacttcgtggaaggcatgtcaggtgggacctgggttgatgtcgtcttggaacatggaggttgcgtcaccgttatggcacaggacaagccaacagttgacatagagttggtcacgacaacggttagtaacatggccgaggtaagatcctactgttatgaggcatcaatatcagacatggcttcggacagtcgctgcccaacacaaggtgaagcctaccttgataagcaatcagacacccaatatgtgtgcaaaagaacattggtggacagaggttggggaaatgggtgtggactttttggcaaagggagcctggtgacatgtgccaagttcacgtgttccaagaagatgactgggaagagcattcagccggagaatctggagtatcgaataatgctatcagtgcatggctcccagcacagcgggatgattgttaatgacataggacatgaaactgacgaaaacagagcgaaagtcgaggtcacgcccaattcaccaagagcagaagcaaccttgggaggctttggaagcttaggacttgattgtgaaccaaggacaggcctggacttttcagatttgtactacttgaccatgaacaacaagcactggttggtgcacaaagagtggtttcatgacatcccattgccttggcatgctggggcagataccggaactccacactggaacaacaaggaggcattggtagagttcaaagatgcccacgccaagaggcaaaccgtcgttgttctagggagccaggaaggagccgttcacacggctcttgctggagctctggaggctgagatggatggtgcaaaaggaaggctgttctccggccatttgaaatgccgcttaaaaatggacaagcttagattgaagggcgtgtcatattccttgtgcaccgcagcgttcacatttaccaaggtcccagctgaaacattgcatggaacagttacagtggaggtgcagtatgcagggacagatggaccctgcaaggtcccagcccagatggcggtggacatgcagaccctgaccccagtcgggaggctgataaccgccaaccctgtgattactgaaagcactgagaattcaaagatgatgttggagctcgacccaccatttggggattcttacattgtcataggagttggggacaagaaaatcacccatcactggcataggagtggtagcaccatcggaaaagcatttgaggccactgtgagaggtgccaagagaatggcagttctgggggatacagcctgggacttcggatcagtcgggggcgtgttcaactcattgggcaagggtgttcaccagatttttggagcagctttcaaatcactgtttggaggaatgtcctggttctcacagatcctcataggcacgctgctggtgtggttgggtttgaacacaaagaatggatccatctccctcacatgcttggccctggggggagtgatgatcttcctctccacggctgtctctgcttaa

SEQ ID NO: 286 - DNA, 2385 bp, Artificial Sequence
  Synthetic
atgaaaaacccaaagaagagatccggaggattccggattgtcaatatgctaaaacgcggagtagcccgtgtaaaccccttggggggtttgaagaggctgccggccggacttctgctgggccatggacccatcagaatggttttggcgatactagcctttttgagattcacagcaatcaagccatcactgggcctcatcaatagatggggttccgtggggaagaaggaggctatggaaataataaaaaagttcaagaaagaccttgctgccatgttgagaattatcaatgctaggaaggagaggaagagacgtggcgctgacaccagcatcggaatcgtcggcctcctgctgaccacagccatggcagccgagatcaccagacgtgggagtgcatactacatgtacttggacaggagcgatgctggtaaggccatttcttttgctaccacattgggggtgaacaaatgccatgtacagatcatggacctcgggcacatgtgtgacgccaccatgagttatgagtgccccatgctggacgagggagtggagccagatgacgtcgattgctggtgcaacacgacatcaacttgggttgtgtacggaacctgtcaacataaaaaaggtgaagcacgacgatccagaagagccgtgacgcttccttctcactccacaaggaagctgcaaacgcgatcacagacttggctagaatcaagagaatacacaaagcacctgatcaaggttgagaattggatattcaggaaccccgggtttgcgctagtggctgtagctattgcctggctcctgggaagctcgacgagccaaaaagtcatatacttggtaatgatattgttgattgccccggcatacagcatcaggtgcataggagttagcaatagagacttcgtggagggcatgtcaggtgggacctgggttgatgttgtcttggaacatgggggttgcgtcaccgtgatggcacaggacaagccaacagttgacatcgagttggtcacgacaacggttagcaacatggccgaggtaagatcctactgctatgaggcatcaatatcggacatggcttcggacagccgctgtccaacacaaggtgaagcctaccttgacaagcagtcagacactcaatatgtctgcaagagaacattggtggatagaggttggggaaatgggtgtggactttttggcaaagggagcttggtgacatgtgccaagtttacgtgctccaagaaaatgacaggcaagagcatccagccggagaacttggagtaccggataatgctatcagtgcatggatcccagcacagtgggatgattgtgaatgacataggacatgaaactgacgaaaacagagcaaaagtcgaggtcacacccaattcaccaagagcagaagcaaccttgggaggttttggaagcttgggacttgactgtgaaccaaggacaggccttgacttctcagatctgtattacctgaccatgaacaataagcattggttggtgcacaaggagtggtttcatgacatcccattaccttggcatgctggtgcagacactggaactccacactggaacaacaaagaggcattggtggagtttaaggacgcccacgccaagaggcaaactgttgtggttctggggagccaagagggagctgttcacacggccctcgctggagctttggaggctgagatggatggtgcaaagggaaggctattctctggccatttgaaatgccgcctaaaaatggacaagcttaggttgaagggtgtgtcatattccctgtgtaccgcagtgtgtaccgcagcgaaggtcccagctgaaacattgcatggaacagtcacagtggaggtgcagtatgcagggacagatggaccctgcaaggtcccagcccagatggcggtagacatgcagaccctgaccccagttggaaggctgataaccgccaaccctgtgatcactgaaagtactgagaattcaaagatgatgttggagctcgacccaccatttggggattcttacattgtcataggagtcggggacaagaaaatcacccatcactggcatcggagtggtagcaccatcggaaaggcatttgaagccactgtgagaggtgccaagagaatggcagtcttgggggacacagcctgggactttggatcagttgggggtgtgtttaattcattgggtaagggtattcaccagatctttggagcagcttttaaatcactgtttggaggaatgtcctggttctcacagatcctcataggcacactgttggtgtggttaggtctgaacacaaagaatggatctatctccctcacatgcttagccctggggggagtgatgatcttcctttccacggctgtttctgcttaa

SEQ ID NO: 287 - DNA, 2091 bp, Artificial Sequence
  Synthetic
atgggcaagaggtccgccggctcaatcatgtggctcgcgagcttggcagttgtcatagcttgtgcaggcgccgccgagatcaccagacgtgggagtgcatactacatgtacttggacaggagcgatgctggtaaggccatttcttttgctaccacattgggggtgaacaaatgccatgtacagatcatggacctcgggcacatgtgtgacgccaccatgagttatgagtgccccatgctggacgagggagtggagccagatgacgtcgattgctggtgcaacacgacatcaacttgggttgtgtacggaacctgtcaacataaaaaaggtgaagcacgacgatccagaagagccgtgacgcttccttctcactccacaaggaagctgcaaacgcgatcacagacttggctagaatcaagagaatacacaaagcacctgatcaaggttgagaattggatattcaggaaccccgggtttgcgctagtggctgtagctattgcctggctcctgggaagctcgacgagccaaaaagtcatatacttggtaatgatattgttgattgccccggcatacagcatcaggtgcataggagttagcaatagagacttcgtggagggcatgtcaggtgggacctgggttgatgttgtcttggaacatgggggttgcgtcaccgtgatggcacaggacaagccaacagttgacatcgagttggtcacgacaacggttagcaacatggccgaggtaagatcctactgctatgaggcatcaatatcggacatggcttcggacagccgctgtccaacacaaggtgaagcctaccttgacaagcagtcagacactcaatatgtctgcaagagaacattggtggatagaggttggggaaatgggtgtggactttttggcaaagggagcttggtgacatgtgccaagtttacgtgctccaagaaaatgacaggcaagagcatccagccggagaacttggagtaccggataatgctatcagtgcatggatcccagcacagtgggatgattgtgaatgacataggacatgaaactgacgaaaacagagcaaaagtcgaggtcacacccaattcaccaagagcagaagcaaccttgggaggttttggaagcttgggacttgactgtgaaccaaggacaggccttgacttctcagatctgtattacctgaccatgaacaataagcattggttggtgcacaaggagtggtttcatgacatcccattaccttggcatgctggtgcagacactggaactccacactggaacaacaaagaggcattggtggagtttaaggacgcccacgccaagaggcaaactgttgtggttctggggagccaagagggagctgttcacacggccctcgctggagctttggaggctgagatggatggtgcaaagggaaggctattctctggccatttgaaatgccgcctaaaaatggacaagcttaggttgaagggtgtgtcatattccctgtgtaccgcagtgtgtaccgcagcgaaggtcccagctgaaacattgcatggaacagtcacagtggaggtgcagtatgcagggacagatggaccctgcaaggtcccagcccagatggcggtagacatgcagaccctgaccccagttggaaggctgataaccgccaaccctgtgatcactgaaagtactgagaattcaaagatgatgttggagctcgacccaccatttggggattcttacattgtcataggagtcggggacaagaaaatcacccatcactggcatcggagtggtagcaccatcggaaaggcatttgaagccactgtgagaggtgccaagagaatggcagtcttgggggacacagcctgggactttggatcagttgggggtgtgtttaattcattgggtaagggtattcaccagatctttggagcagcttttaaatcactgtttggaggaatgtcctggttctcacagatcctcataggcacactgttggtgtggttaggtctgaacacaaagaatggatctatctccctcacatgcttagccctggggggagtgatgatcttcctttccacggctgtttctgcttaa

SEQ ID NO: 288 - DNA, 2373 bp, Artificial Sequence
  Synthetic
atgaaaaaccccaaagaagaaatccggaggatccggattgtcaatatgctaaaacgcggagtagcccgtgtaaaccccttgggaggtttgaagaggttgccagccggacttctgctgggtcatggacccatcagaatggttttggcgatactagcctttttgagatttacagcaatcaagccatcactgggccttatcaacagatggggttccgtggggaaaaaagaggctatggaaataataaagaagttcaagaaagatcttgctgccatgttgagaataatcaatgctaggaaagagaggaagagacgtggcgcagacaccagcatcggaatcattggcctcctgctgactacagccatggcagcagagatcactagacgcgggagtgcatactacatgtacttggataggagcgatgccgggaaggccatttcgtttgctaccacattgggagtgaacaagtgccacgtacagatcatggacctcgggcacatgtgtgacgccaccatgagttatgagtgccctatgctggatgagggagtggaaccagatgatgtcgattgctggtgcaacacgacatcaacttgggttgtgtacggaacctgtcatcacaaaaaaggtgaggcacggcgatctagaagagccgtgacgctcccttctcactctacaaggaagttgcaaacgcggtcgcagacctggttagaatcaagagaatacacgaagcacttgatcaaggttgaaaactggatattcaggaaccccgggtttgcgctagtggccgttgccattgcctggcttttgggaagctcgacgagccaaaaagtcatatacttggtcatgatactgctgattgccccggcatacagtatcaggtgcattggagtcagcaatagagacttcgtggagggcatgtcaggtgggacctgggttgatgttgtcttggaacatggaggctgcgttaccgtgatggcacaggacaagccaacagtcgacatagagttggtcacgacgacggttagtaacatggccgaggtaagatcctattgctacgaggcatcgatatcggacatggcttcggacagtcgttgcccaacacaaggtgaagcctaccttgacaagcaatcagacactcaatatgtctgcaaaagaacattagtggacagaggttggggaaacggttgtggactttttggcaaagggagcttggtgacatgtgccaagtttacgtgttctaagaagatgaccgggaagagcattcaaccggaaaatctggagtatcggataatgctatcagtgcatggctcccagcatagcgggatgattggatatgaaactgacgaagatagagcgaaagtcgaggttacgcctaattcaccaagagcggaagcaaccttgggaggctttggaagcttaggacttgactgtgaaccaaggacaggccttgacttttcagatctgtattacctgaccatgaacaataagcattggttggtgcacaaagagtggtttcatgacatcccattgccttggcatgctggggcagacaccggaactccacactggaacaacaaagaggcattggtagaattcaaggatgcccacgccaagaggcaaaccgtcgtcgttctggggagccaggaaggagccgttcacacggctctcgctggagctctagaggctgagatggatggtgcaaagggaaggctgttctctggccatttgaaatgccgcctaaaaatggacaagcttagattgaagggcgtgtcatattccttgtgcactgcggcattcacattcaccaaggtcccagctgaaacactgcatggaacagtcacagtggaggtgcagtatgcagggacagatggaccctgcaagatcccagtccagatggcggtggacatgcagaccctgaccccagttggaaggctgataaccgccaaccccgtgattactgaaagcactgagaactcaaagatgatgttggagcttgacccaccatttggggattcttacattgtcataggagttggggacaagaaaatcacccaccactggcataggagtggtagcaccatcggaaaggcatttgaggccactgtgagaggcgccaagagaatggcagtcctgggggatacagcctgggacttcggatcagtcgggggtgtgttcaactcactgggtaagggcattcaccagatttttggagcagccttcaaatcactgtttggaggaatgtcctggttctcacagatcctcataggcacgctgctagtgtggttaggtttgaacacaaagaatggatctatctccctcacatgcttggccctggggggagtgatgatcttcctctccacggctgtttctgcttaa

SEQ ID NO: 289 - DNA, 2079 bp, Artificial Sequence
  Synthetic
atgggcaagaggtccgccggctcaatcatgtggctcgcgagcttggcagttgtcatagcttgtgcaggcgccgcagagatcactagacgcgggagtgcatactacatgtacttggataggagcgatgccgggaaggccatttcgtttgctaccacattgggagtgaacaagtgccacgtacagatcatggacctcgggcacatgtgtgacgccaccatgagttatgagtgccctatgctggatgagggagtggaaccagatgatgtcgattgctggtgcaacacgacatcaacttgggttgtgtacggaacctgtcatcacaaaaaaggtgaggcacggcgatctagaagagccgtgacgctcccttctcactctacaaggaagttgcaaacgcggtcgcagacctggttagaatcaagagaatacacgaagcacttgatcaaggttgaaaactggatattcaggaaccccgggtttgcgctagtggccgttgccattgcctggcttttgggaagctcgacgagccaaaaagtcatatacttggtcatgatactgctgattgccccggcatacagtatcaggtgcattggagtcagcaatagagacttcgtggagggcatgtcaggtgggacctgggttgatgttgtcttggaacatggaggctgcgttaccgtgatggcacaggacaagccaacagtcgacatagagttggtcacgacgacggttagtaacatggccgaggtaagatcctattgctacgaggcatcgatatcggacatggcttcggacagtcgttgcccaacacaaggtgaagcctaccttgacaagcaatcagacactcaatatgtctgcaaaagaacattagtggacagaggttggggaaacggttgtggactttttggcaaagggagcttggtgacatgtgccaagtttacgtgttctaagaagatgaccgggaagagcattcaaccggaaaatctggagtatcggataatgctatcagtgcatggctcccagcatagcgggatgattggatatgaaactgacgaagatagagcgaaagtcgaggttacgcctaattcaccaagagcggaagcaaccttgggaggctttggaagcttaggacttgactgtgaaccaaggacaggccttgacttttcagatctgtattacctgaccatgaacaataagcattggttggtgcacaaagagtggtttcatgacatcccattgccttggcatgctggggcagacaccggaactccacactggaacaacaaagaggcattggtagaattcaaggatgcccacgccaagaggcaaaccgtcgtcgttctggggagccaggaaggagccgttcacacggctctcgctggagctctagaggctgagatggatggtgcaaagggaaggctgttctctggccatttgaaatgccgcctaaaaatggacaagcttagattgaagggcgtgtcatattccttgtgcactgcggcattcacattcaccaaggtcccagctgaaacactgcatggaacagtcacagtggaggtgcagtatgcagggacagatggaccctgcaagatcccagtccagatggcggtggacatgcagaccctgaccccagttggaaggctgataaccgccaaccccgtgattactgaaagcactgagaactcaaagatgatgttggagcttgacccaccatttggggattcttacattgtcataggagttggggacaagaaaatcacccaccactggcataggagtggtagcaccatcggaaaggcatttgaggccactgtgagaggcgccaagagaatggcagtcctgggggatacagcctgggacttcggatcagtcgggggtgtgttcaactcactgggtaagggcattcaccagatttttggagcagccttcaaatcactgtttggaggaatgtcctggttctcacagatcctcataggcacgctgctagtgtggttaggtttgaacacaaagaatggatctatctccctcacatgcttggccctggggggagtgatgatcttcctctccacggctgtttctgcttaa

SEQ ID NO: 290 - DNA, 2385 bp, Artificial Sequence
  Synthetic
atgaaaaacccaaagaagaaatccggaggattccggattgtcaatatgctaaaacgcggagtagcccgtgtaaaccccttgggaggtttgaagaggttgccagccggacttctgctgggtcatggacccatcagaatggttttggcgatactagcctttttgagatttacagcaatcaagccatcactgggccttatcaacagatggggttccgtggggaaaaaagaggctatggaaataataaagaagttcaagaaagatcttgctgccatgttgagaataatcaatgctaggaaagagaggaagagacgtggcgcagacaccagcatcggaatcattggcctcctgctgactacagccatggcagcagagatcactagacgcgggagtgcatactacatgtacttggataggagcgatgccgggaaggccatttcgtttgctaccacattgggagtgaacaagtgccacgtacagatcatggacctcgggcacatgtgtgacgccaccatgagttatgagtgccctatgctggatgagggagtggaaccagatgatgtcgattgctggtgcaacacgacatcaacttgggttgtgtacggaacctgtcatcacaaaaaaggtgaggcacggcgatctagaagagccgtgacgctcccttctcactctacaaggaagttgcaaacgcggtcgcagacctggttagaatcaagagaatacacgaagcacttgatcaaggttgaaaactggatattcaggaaccccgggtttgcgctagtggccgttgccattgcctggcttttgggaagctcgacgagccaaaaagtcatatacttggtcatgatactgctgattgccccggcatacagtatcaggtgcattggagtcagcaatagagacttcgtggagggcatgtcaggtgggacctgggttgatgttgtcttggaacatggaggctgcgttaccgtgatggcacaggacaagccaacagttgacatagagttggtcacgacgacggttagtaacatggccgaggtaagatcctattgctacgaggcatcgatatcggacatggcttcggacagtcgttgcccaacacaaggtgaagcctaccttgacaagcaatcagacactcaatatgtctgcaaaagaacattagtggacagaggttggggaaacggttgtggactttttggcaaagggagcttggtgacatgtgccaagtttacgtgttctaagaagatgaccgggaagagcattcaaccggaaaatctggagtatcggataatgctatcagtgcatggctcccagcatagcgggatgattgtcaatgatacaggatatgaaactgacgaaaatagagcgaaagtcgaggttacgcctaattcaccaagagcggaagcaaccttgggaggctttggaagcttaggacttgactgtgaaccaaggacaggccttgacttttcagatctgtattacctgaccatgaacaataagcattggttggtgcacaaagagtggtttcatgacatcccattgccttggcatgctggggcagacaccggaactccacactggaacaacaaagaggcattggtagaattcaaggatgcccacgccaagaggcaaaccgtcgtcgttctggggagccaggaaggagccgttcacacggctctcgctggagctctagaggctgagatggatggtgcaaagggaaagctgttctctggccatttgaaatgccgcctaaaaatggacaagcttagattgaagggcgtgtcatattccttgtgcactgcggcattcacattcaccaaggtcccagctgaaacactgcatggaacagtcacagtggaggtgcagtatgcagggacagatggaccctgcaagatcccagtccagatggcggtggacatgcagaccctgaccccagttggaaggctgataaccgccaaccccgtgattactgaaagcactgagaactcaaagatgatgttggagcttgacccaccatttggggattcttacattgtcataggagttggggacaagaaaatcacccaccactggcataggagtggtagcaccatcggaaaggcatttgaggccactgtgagaggcgccaagagaatggcagtcctgggggatacagcctgggacttcggatcagtcgggggtgtgttcaactcactgggtaagggcattcaccagatttttggagcagccttcaaatcactgtttggaggaatgtcctggttctcacagatcctcataggcacgctgctagtgtggttaggtttgaacacaaagaatggatctatctccctcacatgcttggccctggggggagtgatgatcttcctctccacggctgtttctgcttaa

SEQ ID NO: 291 - DNA, 2091 bp, Artificial Sequence
  Synthetic
atgggcaagaggtccgccggctcaatcatgtggctcgcgagcttggcagttgtcatagcttgtgcaggcgccgcagagatcactagacgcgggagtgcatactacatgtacttggataggagcgatgccgggaaggccatttcgtttgctaccacattgggagtgaacaagtgccacgtacagatcatggacctcgggcacatgtgtgacgccaccatgagttatgagtgccctatgctggatgagggagtggaaccagatgatgtcgattgctggtgcaacacgacatcaacttgggttgtgtacggaacctgtcatcacaaaaaaggtgaggcacggcgatctagaagagccgtgacgctcccttctcactctacaaggaagttgcaaacgcggtcgcagacctggttagaatcaagagaatacacgaagcacttgatcaaggttgaaaactggatattcaggaaccccgggtttgcgctagtggccgttgccattgcctggcttttgggaagctcgacgagccaaaaagtcatatacttggtcatgatactgctgattgccccggcatacagtatcaggtgcattggagtcagcaatagagacttcgtggagggcatgtcaggtgggacctgggttgatgttgtcttggaacatggaggctgcgttaccgtgatggcacaggacaagccaacagttgacatagagttggtcacgacgacggttagtaacatggccgaggtaagatcctattgctacgaggcatcgatatcggacatggcttcggacagtcgttgcccaacacaaggtgaagcctaccttgacaagcaatcagacactcaatatgtctgcaaaagaacattagtggacagaggttggggaaacggttgtggactttttggcaaagggagcttggtgacatgtgccaagtttacgtgttctaagaagatgaccgggaagagcattcaaccggaaaatctggagtatcggataatgctatcagtgcatggctcccagcatagcgggatgattgtcaatgatacaggatatgaaactgacgaaaatagagcgaaagtcgaggttacgcctaattcaccaagagcggaagcaaccttgggaggctttggaagcttaggacttgactgtgaaccaaggacaggccttgacttttcagatctgtattacctgaccatgaacaataagcattggttggtgcacaaagagtggtttcatgacatcccattgccttggcatgctggggcagacaccggaactccacactggaacaacaaagaggcattggtagaattcaaggatgcccacgccaagaggcaaaccgtcgtcgttctggggagccaggaaggagccgttcacacggctctcgctggagctctagaggctgagatggatggtgcaaagggaaagctgttctctggccatttgaaatgccgcctaaaaatggacaagcttagattgaagggcgtgtcatattccttgtgcactgcggcattcacattcaccaaggtcccagctgaaacactgcatggaacagtcacagtggaggtgcagtatgcagggacagatggaccctgcaagatcccagtccagatggcggtggacatgcagaccctgaccccagttggaaggctgataaccgccaaccccgtgattactgaaagcactgagaactcaaagatgatgttggagcttgacccaccatttggggattcttacattgtcataggagttggggacaagaaaatcacccaccactggcataggagtggtagcaccatcggaaaggcatttgaggccactgtgagaggcgccaagagaatggcagtcctgggggatacagcctgggacttcggatcagtcgggggtgtgttcaactcactgggtaagggcattcaccagatttttggagcagccttcaaatcactgtttggaggaatgtcctggttctcacagatcctcataggcacgctgctagtgtggttaggtttgaacacaaagaatggatctatctccctcacatgcttggccctggggggagtgatgatcttcctctccacggctgtttctgcttaa

SEQ ID NO: 292 - DNA, 2385 bp, Artificial Sequence
  Synthetic
atgaaaaacccaaaaaagaaatccggaggattccggattgtcaatatgctaaaacgcggagtagcccgtgtgagcccctttgggggcttgaagaggctgccagccggacttctgctgggccatgggcccatcaggatggtcttggcgatactagcctttttgagattcacggcaatcaagccatcactgggtctcatcaatagatggggttcagtggggaaaaaagaggctatggaaataataaagaagttcaagaaagatctggctgccatgctgagaataatcaatgctaggaaggagaagaagagacgaggcgcagatactagcgtcggaattgttggcctcctcctgaccacagccatggcagtagaggtcactagacgtgggagtgcatactatatgtacttggacagaagcgatgctggggaggccatatcttttccaaccacactggggatgaataagtgttacatacaaatcatggatcttggacacatgtgtgatgccaccatgagctatgaatgccctatgttggatgagggggtagaaccagatgacgtcgattgctggtgcaacacgacatcaacttgggttgtgtatggaacctgccaccacaaaaaaggtgaagcacggagatctagaagagctgtgacgctcccctcccattccactaggaagctgcaaacgcggtcgcagacctggttggaatcaagagaatacacaaagcacctgattagagttgaaaattggatattcaggaaccctggcttcgcgttagcagcagctgtcatcgcttggcttttgggaagttcaacgagccaaaaagtcatatatctggtcatgatactgctgattgccccggcatacagcatcaggtgcataggagtcagcaatagggactttgtggaaggtatgtcaggtgggacttgggttgatgttgtcttggaacatggaggttgtgttaccgtaatggcacaggacaaaccgactgtcgacatagagctggttacaacaacagtcagcaacatggcggaggtaagatcctactgctatgaggcatcaatatcggatatggcttcggacagccgctgcccaacacaaggtgaggcctaccttgacaagcagtcagacactcaatatgtctgcaaaagaacgttagtggacagaggctggggaaatggatgtggactttttggcaaagggagcctggtgacatgcgctaagtttgcatgctccaagaaaatgaccgggaagagcatccagccagagaatctggagtaccggataatgctgtcagttcatggctcccagcacagtgggatgatcgttaatgacacaggacatgaaactgatgagaatagagcgaaggttgagataacgcccaattcaccaagagccgaagccaccctggggggttttgggagcctaggacttgattgtgaaccgaggacaggccttgacttttcagatttgtattacctgactatgaataacaagcactggttggttcacaaggagtggttccacgacattccattaccttggcatgctggggcagacactggaactccacattggaacaacaaagaagcactggtagagttcaaggacgcacatgcaaaaaggcaaactgtcgtggttctagggagtcaagaaggagcagttcacacggcccttgctggagctctggaggctgagatggatggagccaagggaaggctgtcctctggccacttgaaatgtcgcctgaaaatggataaacttagattgaagggcgtgtcatactccttgtgcactgcagcgttcacattcaccaagatcccggctgaaacactgcacgggacagtcacagtggaggtacagtacgcagggacagatggaccttgcaaggttccagctcagatggcggtggatatgcaaactctgaccccagttgggaggttgataaccgctaaccctgtaatcactgaaagcaccgagaactctaagatgatgctggaacttgatccaccatttggggactcttacattgtcataggagtcggggagaagaagatcacccatcactggcacaggagtggcagcaccattggaaaagcatttgaagccactgtgagaggtgccaagagaatggcagtcttgggagacacagcctgggactttggatcagttgggggtgctctcaactcattgggcaagggcatccatcaaatttttggagcagctttcaaatcattgttcggaggaatgtcctggttctcacaaattctcattggaacgttgctggtgtggttgggtctgaatacaaagaatggatctatttcccttacgtgcttggccttagggggagtgttgatcttcttatccacagccgtttctgcttaa

SEQ ID NO: 293 - DNA, 2091 bp, Artificial Sequence
  Synthetic
atgggcaagaggtccgccggctcaatcatgtggctcgcgagcttggcagttgtcatagcttgtgcaggcgccgtagaggtcactagacgtgggagtgcatactatatgtacttggacagaagcgatgctggggaggccatatcttttccaaccacactggggatgaataagtgttacatacaaatcatggatcttggacacatgtgtgatgccaccatgagctatgaatgccctatgttggatgagggggtagaaccagatgacgtcgattgctggtgcaacacgacatcaacttgggttgtgtatggaacctgccaccacaaaaaaggtgaagcacggagatctagaagagctgtgacgctcccctcccattccactaggaagctgcaaacgcggtcgcagacctggttggaatcaagagaatacacaaagcacctgattagagttgaaaattggatattcaggaaccctggcttcgcgttagcagcagctgtcatcgcttggcttttgggaagttcaacgagccaaaaagtcatatatctggtcatgatactgctgattgccccggcatacagcatcaggtgcataggagtcagcaatagggactttgtggaaggtatgtcaggtgggacttgggttgatgttgtcttggaacatggaggttgtgttaccgtaatggcacaggacaaaccgactgtcgacatagagctggttacaacaacagtcagcaacatggcggaggtaagatcctactgctatgaggcatcaatatcggatatggcttcggacagccgctgcccaacacaaggtgaggcctaccttgacaagcagtcagacactcaatatgtctgcaaaagaacgttagtggacagaggctggggaaatggatgtggactttttggcaaagggagcctggtgacatgcgctaagtttgcatgctccaagaaaatgaccgggaagagcatccagccagagaatctggagtaccggataatgctgtcagttcatggctcccagcacagtgggatgatcgttaatgacacaggacatgaaactgatgagaatagagcgaaggttgagataacgcccaattcaccaagagccgaagccaccctggggggttttgggagcctaggacttgattgtgaaccgaggacaggccttgacttttcagatttgtattacctgactatgaataacaagcactggttggttcacaaggagtggttccacgacattccattaccttggcatgctggggcagacactggaactccacattggaacaacaaagaagcactggtagagttcaaggacgcacatgcaaaaaggcaaactgtcgtggttctagggagtcaagaaggagcagttcacacggcccttgctggagctctggaggctgagatggatggagccaagggaaggctgtcctctggccacttgaaatgtcgcctgaaaatggataaacttagattgaagggcgtgtcatactccttgtgcactgcagcgttcacattcaccaagatcccggctgaaacactgcacgggacagtcacagtggaggtacagtacgcagggacagatggaccttgcaaggttccagctcagatggcggtggatatgcaaactctgaccccagttgggaggttgataaccgctaaccctgtaatcactgaaagcaccgagaactctaagatgatgctggaacttgatccaccatttggggactcttacattgtcataggagtcggggagaagaagatcacccatcactggcacaggagtggcagcaccattggaaaagcatttgaagccactgtgagaggtgccaagagaatggcagtcttgggagacacagcctgggactttggatcagttgggggtgctctcaactcattgggcaagggcatccatcaaatttttggagcagctttcaaatcattgttcggaggaatgtcctggttctcacaaattctcattggaacgttgctggtgtggttgggtctgaatacaaagaatggatctatttcccttacgtgcttggccttagggggagtgttgatcttcttatccacagccgtttctgcttaa

SEQ ID NO: 294 - DNA, 2385 bp, Artificial Sequence
  Synthetic
atgaaaaacccaaaaaagaaatccggaggattccggattgtcaatatgctaaaacgcggagtagcccgtgtgagcccctttgggggcttgaagaggctgccagccggacttctgctgggtcatgggcccatcaggatggtcttggcgattctagcctttttgagattcacggcaatcaagccatcactgggtctcatcaatagatggggttcagtgggaaaaaaagaggctatggaaataataaagaagttcaagaaagatctggctgccatgctgagaataatcaatgctaggaaggagaagaagagacgaggcacagatactagtgtcggaattgttggcctcctgctgaccacagctatggcagcggaggtcactagacgtgggagtgcatactatatgtacttggacagaagcgatgctggggaggccatatcttttccaaccacactggggatgaataagtgttatatacagatcatggatcttggacacatgtgtgatgccaccatgagctatgaatgccctatgctggatgagggggtagaaccagatgacgtcgattgttggtgcaacacgacgtcaacttgggttgtgtacggaacctgccatcacaaaaaaggtgaagcacggagatccagaagagctgtgacgctcccctcccattccactaggaagctgcaaacgcggtcgcagacctggttggaatcaagagaatacacaaagcacttgattagagtcgaaaattggatattcaggaaccctggcttcgcgttagcagcagctgccatcgcttggcttttgggaagctcaacgagccaaaaagtcatatacttggtcatgatactgctgattgccccggcatacagcatcaggtgcataggagtcagtaatagggactttgtggaaggtatgtcaggtgggacttgggttgatgttgtcttggaacatggaggttgtgtcaccgtaatggcacaggacaaaccgactgtcgacatagagctggttacaacaacagtcagcaacatggcggaggtaagatcctactgctatgaggcatcaatatcggacatggcttcggacagccgctgcccaacacaaggtgaagcctaccttgacaagcaatcagacactcaatatgtctgcaaaagaacgttagtggacagaggctggggaaatggatgtggactttttggcaaagggagcctggtgacatgcgctaagtttgcatgctccaagaaaatgaccgggaagagcatccagccagagaatctggagtaccggataatgctgtcagttcatggctcccagcacagtgggatgatcgttaatgacacaggacatgaaactgatgagaatagagcgaaggttgagataacgcccaattcaccaagagccgaagccaccctggggggttttggaagcctaggacttgattgtgaaccgaggacaggccttgacttttcagatttgtattacttgactatgaacaacaagcactggttggttcacaaggagtggttccacgacattccattaccttggcacactggggcagacaccggaactccacactggaacaacaaagaagcactggtagagttcaaggacgcacatgccaaaaggcaaactgtcgtggttctagggagtcaagaaggagcagttcacacggcccttgctggagctctggaggctgagatggatggtgcaaagggaaggctgtcctctggccacttgaaatgtcgcctgaaaatggataaacttagattgaagggcgtgtcatactccttgtgtaccgcagcgttcacattcaccaagatcccggctgaaacactgcacgggacagtcacagtggaggtacagtacgcagggacagatggaccttgcaaggttccagctcagatggcggtggacatgcaaactctgaccccagttgggaggttgataaccgctaaccccgtaatcactgaaggcactgagaactctaagatgatgctggaacttgatccaccatttggggactcttacattgtcataggagtcggggagaagaagatcacccaccactggcacaggagtggcagcaccattggaaaagcatttgaagccactgtgagaggtgccaagagaatggcagtcttgggagacacagcctgggactttggatcagttggaggcgttcttaactcattgggcaagggcatccatcaaatttttggagcagctttcaaatcattgtttggaggaatgtcctggttctcacaaattctcattggaacgttgctgatgtggttgggtctgaatacaaagaatggatctatttcccttatgtgcttggccttagggggagtgttgatcttcttatccacagccgtctccgcttaa

SEQ ID NO: 295 - DNA, 2091 bp, Artificial Sequence
  Synthetic
atgggcaagaggtccgccggctcaatcatgtggctcgcgagcttggcagttgtcatagcttgtgcaggcgccgcggaggtcactagacgtgggagtgcatactatatgtacttggacagaagcgatgctggggaggccatatcttttccaaccacactggggatgaataagtgttatatacagatcatggatcttggacacatgtgtgatgccaccatgagctatgaatgccctatgctggatgagggggtagaaccagatgacgtcgattgttggtgcaacacgacgtcaacttgggttgtgtacggaacctgccatcacaaaaaaggtgaagcacggagatccagaagagctgtgacgctcccctcccattccactaggaagctgcaaacgcggtcgcagacctggttggaatcaagagaatacacaaagcacttgattagagtcgaaaattggatattcaggaaccctggcttcgcgttagcagcagctgccatcgcttggcttttgggaagctcaacgagccaaaaagtcatatacttggtcatgatactgctgattgccccggcatacagcatcaggtgcataggagtcagtaatagggactttgtggaaggtatgtcaggtgggacttgggttgatgttgtcttggaacatggaggttgtgtcaccgtaatggcacaggacaaaccgactgtcgacatagagctggttacaacaacagtcagcaacatggcggaggtaagatcctactgctatgaggcatcaatatcggacatggcttcggacagccgctgcccaacacaaggtgaagcctaccttgacaagcaatcagacactcaatatgtctgcaaaagaacgttagtggacagaggctggggaaatggatgtggactttttggcaaagggagcctggtgacatgcgctaagtttgcatgctccaagaaaatgaccgggaagagcatccagccagagaatctggagtaccggataatgctgtcagttcatggctcccagcacagtgggatgatcgttaatgacacaggacatgaaactgatgagaatagagcgaaggttgagataacgcccaattcaccaagagccgaagccaccctggggggttttggaagcctaggacttgattgtgaaccgaggacaggccttgacttttcagatttgtattacttgactatgaacaacaagcactggttggttcacaaggagtggttccacgacattccattaccttggcacactggggcagacaccggaactccacactggaacaacaaagaagcactggtagagttcaaggacgcacatgccaaaaggcaaactgtcgtggttctagggagtcaagaaggagcagttcacacggcccttgctggagctctggaggctgagatggatggtgcaaagggaaggctgtcctctggccacttgaaatgtcgcctgaaaatggataaacttagattgaagggcgtgtcatactccttgtgtaccgcagcgttcacattcaccaagatcccggctgaaacactgcacgggacagtcacagtggaggtacagtacgcagggacagatggaccttgcaaggttccagctcagatggcggtggacatgcaaactctgaccccagttgggaggttgataaccgctaaccccgtaatcactgaaggcactgagaactctaagatgatgctggaacttgatccaccatttggggactcttacattgtcataggagtcggggagaagaagatcacccaccactggcacaggagtggcagcaccattggaaaagcatttgaagccactgtgagaggtgccaagagaatggcagtcttgggagacacagcctgggactttggatcagttggaggcgttcttaactcattgggcaagggcatccatcaaatttttggagcagctttcaaatcattgtttggaggaatgtcctggttctcacaaattctcattggaacgttgctgatgtggttgggtctgaatacaaagaatggatctatttcccttatgtgcttggccttagggggagtgttgatcttcttatccacagccgtctccgcttaa

SEQ ID NO: 296 - DNA, 2385 bp, Artificial Sequence
  Synthetic
atgaaaaacccaaaaaagaaatccggaggattccggattgtcaatatgctaaaacgcggagtagcccgtgtgagcccctttgggggcttgaagaggctgccagccggacttctgctgggtcatgggcccatcaggatggtcttggcgattctagcctttttgagattcacggcaatcaagccatcactgggtctcatcaatagatggggttcagtggggaaaaaagaggctatggaaataataaagaagttcaagaaagatctggctgccatgctgagaataatcaatgctaggaaggagaagaagagacgaggcgcagatactagtgtcggaattgttggcctcctgctgaccacagctatggcagcggaggtcactagacgtgggagtgcatactatatgtacttggacagaaacgacgctggggaggccatatcttttccaaccacattggggatgaataagtgttatatacagatcatggatcttggacacatgtgtgatgccaccatgagctatgaatgccctatgctggatgagggggtggaaccagatgacgtcgattgttggtgcaacacgacgtcaacttgggttgtgtacggaacctgccatcacaaaaaaggtgaagcacggagatctagaagagctgtgacgctcccctcccattccactaggaagctgcaaacgcggtcgcaaacctggttggaatcaagagaatacacaaagcacttgattagagtcgaaaattggatattcaggaaccctggcttcgcgttagcagcagctgccatcgcttggcttttgggaagctcaacgagccaaaaagtcatatacttggtcatgatactgctgattgccccggcatacagcatcaggtgcataggagtcagcaatagggactttgtggaaggtatgtcaggtgggacttgggttgatgttgtcttggaacatggaggttgtgtcaccgtaatggcacaggacaaaccgactgtcgacatagagctggttacaacaacagtcagcaacatggcggaggtaagatcctactgctatgaggcatcaatatcggacatggcttcggacagccgctgcccaacacaaggtgaagcctaccttgacaagcaatcagacactcaatatgtctgcaaaagaacgttagtggacagaggctggggaaatggatgtggactttttggcaaagggagcctggtgacatgcgctaagtttgcatgctccaagaaaatgaccgggaagagcatccagccagagaatctggagtaccggataatgctgtcagttcatggctcccagcacagtgggatgatcgttaatgacgcaggacatgaaactgatgagaatagagcgaaggttgagataacgcccaattcaccaagagccgaagccaccctggggggttttggaagcctaggacttgattgtgaaccgaggacaggccttgacttttcagatttgtattacttgactatgaataacaagcactggttggttcacaaggagtggttccacgacattccattaccttggcacgctggggcagacaccggaactccacactggaacaacaaagaagcactggtagagttcaaggacgcacatgccaaaaggcaaactgtcgtggttctagggagtcaagaaggagcagttcacacggcccttgctggagctctggaggctgagatggatggtgcaaagggaaggctgtcctctggccacttgaaatgtcgcctgaaaatggataaacttagattgaagggcgtgtcatactccttgtgtaccgcagcgttcacattcaccaagatcccggctgaaacactgcacgggacagtcacagtggaggtacagtacgcagggacagatggaccttgcaaggttccagctcagatggcggtggacatgcaaactctgaccccagttgggaggttgataaccgctaaccccgtaatcactgaaagcactgagaactctaagatgatgctggaacttgatccaccatttggggactcttacattgtcataggagtcggggagaagaagatcacccaccactggcacaggagtggcagcaccattggaaaagcatttgaagccactgtgagaggtgccaagagaatggcagtcttgggagacacagcctgggactttggatcagttggaggcgctctcaactcattgggcaagggcatccatcaaatttttggagcagctttcaaatcattgtttggaggaatgtcctggttctcacaaattctcattggaacgttgctgatgtggttgggtctgaacacaaagaatggatctatttcccttatgtgcttggccttagggggagtgttgatcttcttatccacagctgtctctgcttaa

SEQ ID NO: 297 - DNA, 2385 bp, Artificial Sequence
  Synthetic
atgaaaaacccaaaaaagaaatccggaggattccggattgtcaatatgctaaaacgcggagtagcccgtgtgagcccctttgggggcttgaagaggctgccagccggacttctgctgggtcatgggcccatcaggatggtcttggcgattctagcctttttgagattcacggcaatcaagccatcactgggtctcatcaatagatggggttcagtggggaaaaaagaggctatggaaataataaagaagttcaagaaagatctggctgccatgctgagaataatcaatgctaggaaggagaagaagagacgaggcgcagatactagtgtcggaattgttggcctcctgctgaccacagctatggcagcggaggtcactagacgtgggagtgcatactatatgtacttggacagaaacgacgctggggaggccatatcttttccaaccacattggggatgaataagtgttatatacagatcatggatcttggacacatgtgtgatgccaccatgagctatgaatgccctatgctggatgagggggtggaaccagatgacgtcgattgttggtgcaacacgacgtcaacttgggttgtgtacggaacctgccatcacaaaaaaggtgaagcacggagatctagaagagctgtgacgctcccctcccattccactaggaagctgcaaacgcggtcgcaaacctggttggaatcaagagaatacacaaagcacttgattagagtcgaaaattggatattcaggaaccctggcttcgcgttagcagcagctgccatcgcttggcttttgggaagctcaacgagccaaaaagtcatatacttggtcatgatactgctgattgccccggcatacagcatcaggtgcataggagtcagcaatagggactttgtggaaggtatgtcaggtgggacttgggttgatgttgtcttggaacatggaggttgtgtcaccgtaatggcacaggacaaaccgactgtcgacatagagctggttacaacaacagtcagcaacatggcggaggtaagatcctactgctatgaggcatcaatatcggacatggcttcggacagccgctgcccaacacaaggtgaagcctaccttgacaagcaatcagacactcaatatgtctgcaaaagaacgttagtggacagaggctggggaaatggatgtggactttttggcaaagggagcctggtgacatgcgctaagtttgcatgctccaagaaaatgaccgggaagagcatccagccagagaatctggagtaccggataatgctgtcagttcatggaccaactactgtggagtcgcacggaaattacgccacacaggttggagccactcaggcagcgaaggttgagataacgcccaattcaccaagagccgaagccaccctggggggttttggaagcctaggacttgattgtgaaccgaggacaggccttgacttttcagatttgtattacttgactatgaataacaagcactggttggttcacaaggagtggttccacgacattccattaccttggcacgctggggcagacaccggaactccacactggaacaacaaagaagcactggtagagttcaaggacgcacatgccaaaaggcaaactgtcgtggttctagggagtcaagaaggagcagttcacacggcccttgctggagctctggaggctgagatggatggtgcaaagggaaggctgtcctctggccacttgaaatgtcgcctgaaaatggataaacttagattgaagggcgtgtcatactccttgtgtaccgcagcgttcacattcaccaagatcccggctgaaacactgcacgggacagtcacagtggaggtacagtacgcagggacagatggaccttgcaaggttccagctcagatggcggtggacatgcaaactctgaccccagttgggaggttgataaccgctaaccccgtaatcactgaaagcactgagaactctaagatgatgctggaacttgatccaccatttggggactcttacattgtcataggagtcggggagaagaagatcacccaccactggcacaggagtggcagcaccattggaaaagcatttgaagccactgtgagaggtgccaagagaatggcagtcttgggagacacagcctgggactttggatcagttggaggcgctctcaactcattgggcaagggcatccatcaaatttttggagcagctttcaaatcattgtttggaggaatgtcctggttctcacaaattctcattggaacgttgctgatgtggttgggtctgaacacaaagaatggatctatttcccttatgtgcttggccttagggggagtgttgatcttcttatccacagctgtctctgcttaa

SEQ ID NO: 298 - DNA, 2370 bp, Artificial Sequence
  Synthetic
atgaaaaacccaaaaaagaaatccggaggattccggattgtcaatatgctaaaacgcggagtagcccgtgtgagcccctttgggggcttgaagaggctgccagccggacttctgctgggtcatgggcccatcaggatggtcttggcgattctagcctttttgagattcacggcaatcaagccatcactgggtctcatcaatagatggggttcagtggggaaaaaagaggctatggaaataataaagaagttcaagaaagatctggctgccatgctgagaataatcaatgctaggaaggagaagaagagacgaggcgcagatactagtgtcggaattgttggcctcctgctgaccacagctatggcagcggaggtcactagacgtgggagtgcatactatatgtacttggacagaaacgacgctggggaggccatatcttttccaaccacattggggatgaataagtgttatatacagatcatggatcttggacacatgtgtgatgccaccatgagctatgaatgccctatgctggatgagggggtggaaccagatgacgtcgattgttggtgcaacacgacgtcaacttgggttgtgtacggaacctgccatcacaaaaaaggtgaagcacggagatctagaagagctgtgacgctcccctcccattccactaggaagctgcaaacgcggtcgcaaacctggttggaatcaagagaatacacaaagcacttgattagagtcgaaaattggatattcaggaaccctggcttcgcgttagcagcagctgccatcgcttggcttttgggaagctcaacgagccaaaaagtcatatacttggtcatgatactgctgattgccccggcatacagcatcaggtgcataggagtcagcaatagggactttgtggaaggtatgtcaggtgggacttgggttgatgttgtcttggaacatggaggttgtgtcaccgtaatggcacaggacaaaccgactgtcgacatagagctggttacaacaacagtcagcaacatggcggaggtaagatcctactgctatgaggcatcaatatcggacatggcttcggacagccgctgcccaacacaaggtgaagcctaccttgacaagcaatcagacactcaatatgtctgcaaaagaacgttagtggacagaggctggggaaatggatgtggactttttggcaaagggagcctggtgacatgcgctaagtttgcatgctccaagaaaatgaccgggaagagcatccagccagagaatctggagtaccggataatgctgtcagttcatactggagatcagcaccaggtgggaaatgaggctacagaacatggagcgaaggttgagataacgcccaattcaccaagagccgaagccaccctggggggttttggaagcctaggacttgattgtgaaccgaggacaggccttgacttttcagatttgtattacttgactatgaataacaagcactggttggttcacaaggagtggttccacgacattccattaccttggcacgctggggcagacaccggaactccacactggaacaacaaagaagcactggtagagttcaaggacgcacatgccaaaaggcaaactgtcgtggttctagggagtcaagaaggagcagttcacacggcccttgctggagctctggaggctgagatggatggtgcaaagggaaggctgtcctctggccacttgaaatgtcgcctgaaaatggataaacttagattgaagggcgtgtcatactccttgtgtaccgcagcgttcacattcaccaagatcccggctgaaacactgcacgggacagtcacagtggaggtacagtacgcagggacagatggaccttgcaaggttccagctcagatggcggtggacatgcaaactctgaccccagttgggaggttgataaccgctaaccccgtaatcactgaaagcactgagaactctaagatgatgctggaacttgatccaccatttggggactcttacattgtcataggagtcggggagaagaagatcacccaccactggcacaggagtggcagcaccattggaaaagcatttgaagccactgtgagaggtgccaagagaatggcagtcttgggagacacagcctgggactttggatcagttggaggcgctctcaactcattgggcaagggcatccatcaaatttttggagcagctttcaaatcattgtttggaggaatgtcctggttctcacaaattctcattggaacgttgctgatgtggttgggtctgaacacaaagaatggatctatttcccttatgtgcttggccttagggggagtgttgatcttcttatccacagctgtctctgcttaa

SEQ ID NO: 299 - DNA, 2370 bp, Artificial Sequence
  Synthetic
atgaaaaacccaaaaaagaaatccggaggattccggattgtcaatatgctaaaacgcggagtagcccgtgtgagcccctttgggggcttgaagaggctgccagccggacttctgctgggtcatgggcccatcaggatggtcttggcgattctagcctttttgagattcacggcaatcaagccatcactgggtctcatcaatagatggggttcagtggggaaaaaagaggctatggaaataataaagaagttcaagaaagatctggctgccatgctgagaataatcaatgctaggaaggagaagaagagacgaggcgcagatactagtgtcggaattgttggcctcctgctgaccacagctatggcagcggaggtcactagacgtgggagtgcatactatatgtacttggacagaaacgacgctggggaggccatatcttttccaaccacattggggatgaataagtgttatatacagatcatggatcttggacacatgtgtgatgccaccatgagctatgaatgccctatgctggatgagggggtggaaccagatgacgtcgattgttggtgcaacacgacgtcaacttgggttgtgtacggaacctgccatcacaaaaaaggtgaagcacggagatctagaagagctgtgacgctcccctcccattccactaggaagctgcaaacgcggtcgcaaacctggttggaatcaagagaatacacaaagcacttgattagagtcgaaaattggatattcaggaaccctggcttcgcgttagcagcagctgccatcgcttggcttttgggaagctcaacgagccaaaaagtcatatacttggtcatgatactgctgattgccccggcatacagcatcaggtgcataggagtcagcaatagggactttgtggaaggtatgtcaggtgggacttgggttgatgttgtcttggaacatggaggttgtgtcaccgtaatggcacaggacaaaccgactgtcgacatagagctggttacaacaacagtcagcaacatggcggaggtaagatcctactgctatgaggcatcaatatcggacatggcttcggacagccgctgcccaacacaaggtgaagcctaccttgacaagcaatcagacactcaatatgtctgcaaaagaacgttagtggacagaggctggggaaatggatgtggactttttggcaaagggagcctggtgacatgcgctaagtttgcatgctccaagaaaatgaccgggaagagcatccagccagagaatctggagtaccggataatgctgtcagttcattcaggggaagagcatgcagtcggaaatgacgcaggaaaacatggcgcgaaggttgagataacgcccaattcaccaagagccgaagccaccctggggggttttggaagcctaggacttgattgtgaaccgaggacaggccttgacttttcagatttgtattacttgactatgaataacaagcactggttggttcacaaggagtggttccacgacattccattaccttggcacgctggggcagacaccggaactccacactggaacaacaaagaagcactggtagagttcaaggacgcacatgccaaaaggcaaactgtcgtggttctagggagtcaagaaggagcagttcacacggcccttgctggagctctggaggctgagatggatggtgcaaagggaaggctgtcctctggccacttgaaatgtcgcctgaaaatggataaacttagattgaagggcgtgtcatactccttgtgtaccgcagcgttcacattcaccaagatcccggctgaaacactgcacgggacagtcacagtggaggtacagtacgcagggacagatggaccttgcaaggttccagctcagatggcggtggacatgcaaactctgaccccagttgggaggttgataaccgctaaccccgtaatcactgaaagcactgagaactctaagatgatgctggaacttgatccaccatttggggactcttacattgtcataggagtcggggagaagaagatcacccaccactggcacaggagtggcagcaccattggaaaagcatttgaagccactgtgagaggtgccaagagaatggcagtcttgggagacacagcctgggactttggatcagttggaggcgctctcaactcattgggcaagggcatccatcaaatttttggagcagctttcaaatcattgtttggaggaatgtcctggttctcacaaattctcattggaacgttgctgatgtggttgggtctgaacacaaagaatggatctatttcccttatgtgcttggccttagggggagtgttgatcttcttatccacagctgtctctgcttaa

SEQ ID NO: 300 - DNA, 2376 bp, Artificial Sequence
  Synthetic
atgtctaagaaaccaggagggccctgcaagagccgggctgtcaatatgctaaaacgcggaatgccccgcgtgttgtccttgattggactgaagagggctatgttgagcctgatcgacggcaaggggccaatacgatttgtgttggctctcttggcgttcttcaggttcacagcaattgctccgacccgagcagtgctggatcgatggagaggtgtgaacaaacaaacagcgatgaaacaccttctgagttttaagaaggaactagggaccttgaccagtgctatcaatcggcggagctcaaaacaaaagaaaagaggaggaaagaccggaattgcagtcatgattggcctgatcgccagcgtaggagcagttaccctctctaacttccaagggaaggtgatgatgacggtaaatgctactgacgtcacagatgtcatcacgattccaacagctgctggaaagaacctatgcattgtcagagcaatggatgtgggatacatgtgcgatgatactatcacttatgaatgcccagtgctgtcggctggtaatgatccagaagacatcgactgttggtgcacaaagtcagcagtctacgtcaggtatggaagatgcaccaagacacgccactcaagacgcagtcggaggtcactgacagtgcagacacacggagaaagcactctagcgaacaagaagggggcttggatggacagcaccaaggccacaaggtatttggtaaaaacagaatcatggatcttgaggaaccctggatatgccctggtggcagccgtcattggttggatgcttgggagcaacaccatgcagagagttgtgtttgtcgtgctattgcttttggtggccccagcttacagcttcaactgccttggaatgagcaacagagacttcttggaaggagtgtctggagcaacatgggtggatttggttctcgaaggcgacagctgcgtgactatcatgtctaaggacaagcctaccatcgatgtgaagatgatgaatatggaggcggccaacctggcagaggtccgcagttattgctatttggctaccgtcagcgatctctccaccaaagctgcgtgcccgaccatgggagaagctcacaatgacaaacgtgctgacccagcttttgtgtgcagacaaggagtggtggacaggggctggggcaacggctgcggactatttggcaaaggaagcattgacacatgcgccaaatttgcctgctctaccaaggcaataggaagaaccatcttgaaagagaatatcaagtacgaagtggccatttttgtccatggctcccagcacagtgggatgatcgttaatgacgcaggacatgaaactgatgagaatagagggagattcagcatcactcctgcggcgccttcatacacactaaagcttggagaatatggagaggtgacagtggactgtgaaccacggtcagggattgacaccaatgcatactacgtgatgactgttggaacaaagacgttcttggtccatcgtgagtggttcatggacctcaacctcccttggagcagtgctggaagtactgtgtggaggaacagagagacgttaatggagtttgaggaaccacacgccacgaagcagtctgtgatagcattgggctcacaagagggagctctgcatcaagctttggctggagccattcctgtggaattttcaagcaacactgtcaagttgacgtcgggtcatttgaagtgtagagtgaagatggaaaaattgcagtcgaagggaacaacctatggcgtctgttcaaaggctttcaagtttcttgggactcccgcagacacaggtcacggcactgtggtgttggaattgcagtacactggcacggatggaccttgcaaagttcctatctcgtcagtggcttcattgaacgacctaacgccagtgggcagattggtcactgtcaacccttttgtttcagtggccacggccaacgctaaggtcctgattgaattggaaccaccctttggagactcatacatagtggtgggcagaggagaacaacagatcaatcaccattggcacaagtctggaagcagcattggcaaagcctttacaaccaccctcaaaggagcgcagagactagccgctctaggagacacagcttgggactttggatcagttggaggggtgttcacctcagttgggaaggctgtccatcaagtgttcggaggagcattccgctcactgttcggaggcatgtcctggataacgcaaggattgctgggggctctcctgttgtggatgggcatcaatgctcgtgataggtccatagctctcacgtttctcgcagttggaggagttctgctcttcctctccgtgaacgtgcacgcttaa

SEQ ID NO: 301 - DNA, 2343 bp, Artificial Sequence
  Synthetic
atgatcaaccaacgaaaaaagacgggtcgaccgtctttcaatatgctgaaacgcgcgagaaaccgcgtgtcaactgtttcacagttggcgaagagattctcaaaaggattgctctcaggccaaggacccatgaaattggtgatggctttcatagcattcttaagatttctagccatacccccaacagcaggaattttggctagatggggctcattcaagaagaatggagcgattaaagtgttacggggtttcaagagagaaatctcaaacatgctaaacataatgaacaggaggaaaagatccgtgaccatgctccttatgctgctgcccacagccctggcgttccatctgacgacacgagggggagagccgcatatgatagttagcaagcaggaaagaggaaagtcacttttgttcaagacctctgcaggtgtcaacatgtgcaccctcattgcgatggatttgggagagttgtgtgaggacacgatgacctacaaatgcccccggatcactgaggcggaaccagatgacgttgactgttggtgcaatgccacggacacatgggtgacctatggaacgtgctctcaaactggcgaacaccgacgagacaaacgttccgtcgcattggccccacacgtggggcttggcctagaaacaagagccgaaacgtggatgtcctctgaaggtgcttggaaacagatacaaaaagtagagacttgggctctgagacatccaggattcacggtgatagccctttttctagcacatgccataggaacatccatcacccagaaagggatcattttcattttgctgatgctggtaacaccatctatggccatgcgatgcgtgggaataggcaacagagacttcgtggaaggactgtcaggagcaacatgggtggatgtggtactggagcatggaagttgcgtcaccaccatggcaaaaaacaaaccaacactggacattgaactcttgaagacggaggtcacaaaccctgcagttctgcgtaaattgtgcattgaagctaaaatatcaaacaccaccaccgattcgagatgtccaacacaaggagaagccacactggtggaagaacaagacgcgaactttgtgtgccgacgaacgttcgtggacagaggctggggcaatggctgtgggctattcggaaaaggtagtctaataacgtgtgccaagtttaagtgtgtgacaaaactagaaggaaagatagttcaatatgaaaacctaaaatattcagtgatagtcaccgtccacggctcccagcacagtgggatgatcgttaatgacgcaggacatgaaactgatgagaatagaacaactgcaaccataacacctcaagctcctacgtcggaaatacagctgaccgactacggaacccttacattagattgttcacctaggacagggctagattttaacgagatggtgttgctgacaatgaaagaaagatcatggcttgtccacaaacaatggtttctagacttaccactgccttggacctctggggcttcaacatcccaagagacttggaacagacaagatttactggtcacatttaagacagctcatgcaaagaagcaggaagtagtcgtactaggatcacaagaaggagcaatgcacactgcgctgactggagcgacagaaatccaaacgtcaggaacgacaacaattttcgcaggacacctaaaatgcagactaaaaatggacaaactaactttaaaagggatgtcatatgtgatgtgcacaggctcattcaagttagagaaagaagtggctgagacccagcatggaactgttctggtgcaggttaaatatgaaggaacagacgcaccatgcaagattcccttttcgacccaagatgagaaaggagcaacccagaatgggagattaataacagccaaccccatagtcactgacaaagaaaaaccagtcaatattgaggcagaaccaccctttggtgagagctacatcgtggtaggagcaggtgaaaaagctttgaaactaagctggttcaagaaaggaagcagcatagggaaaatgtttgaagcaactgcccgaggagcacgaaggatggccattctgggagacaccgcatgggacttcggttctataggaggagtgttcacgtctatgggaaaactggtacaccaggtttttggaactgcatatggagttttgtttagcggagtttcttggaccatgaaaataggaatagggattctgctgacatggctaggattaaattcaaggaacacgtccctttcgatgatgtgcatcgcagttggcatggtcacactgtacctaggagtcatggttcaggcataa

SEQ ID NO: 302 - DNA, 2343 bp, Artificial Sequence
  Synthetic
atgaataaccaacggaaaaaggcgaaaaacacgcctttcaatatgctgaaacgcgagagaaaccgcgtgtcgactgtgcaacagctgacaaagagattctcacttggaatgctgcagggacgaggaccattaaaactgttcatggccctggtggcgttccttcgtttcctaacaatcccaccaacagcagggatattgaagagatggggaacaattaaaaaatcaaaagctattaatgttttgagagggttcaggaaagagattggaaggatgctgaacatcttgaataggagacgcagatctgcaggcatgatcattatgctgattccaacagtgatggcgttccatttaaccacacgtaacggagaaccacacatgatcgtcagcagacaagagaaagggaaaagtcttctgtttaaaacagaggatggcgtgaacatgtgtaccctcatggccatggaccttggtgaattgtgtgaagacacaatcacgtacaagtgtccccttctcaggcagaatgagccagaagacatagactgttggtgcaactctacgtccacgtgggtaacttatgggacgtgtaccaccatgggagaacatagaagagaaaaaagatcagtggcactcgttccacatgtgggaatgggactggagacacgaactgaaacatggatgtcatcagaaggggcctggaaacatgtccagagaattgaaacttggatcttgagacatccaggcttcaccatgatggcagcaatcctggcatacaccataggaacgacacatttccaaagagccctgattttcatcttactgacagctgtcactccttcaatgacaatgcgttgcataggaatgtcaaatagagactttgtggaaggggtttcaggaggaagctgggttgacatagtcttagaacatggaagctgtgtgacgacgatggcaaaaaacaaaccaacattggattttgaactgataaaaacagaagccaaacagcctgccaccctaaggaagtactgtatagaggcaaagctaaccaacacaacaacagaatctcgctgcccaacacaaggggaacccagcctaaatgaagagcaggacaaaaggttcgtctgcaaacactccatggtagacagaggatggggaaatggatgtggactatttggaaagggaggcattgtgacctgtgctatgttcagatgcaaaaagaacatggaaggaaaagttgtgcaaccagaaaacttggaatacaccattgtgataacacctcacggctcccagcacagtgggatgatcgttaatgacgcaggacatgaaactgatgagaatagaaaggaaatcaaaataacaccacagagttccatcacagaagcagaattgacaggttatggcactgtcacaatggagtgctctccaagaacgggcctcgacttcaatgagatggtgttgttgcagatggaaaataaagcttggctggtgcacaggcaatggttcctagacctgccgttaccatggttgcccggagcggacacacaagggtcaaattggatacagaaagagacattggtcactttcaaaaatccccatgcgaagaaacaggatgttgttgttttaggatcccaagaaggggccatgcacacagcacttacaggggccacagaaatccaaatgtcatcaggaaacttactcttcacaggacatctcaagtgcaggctgagaatggacaagctacagctcaaaggaatgtcatactctatgtgcacaggaaagtttaaagttgtgaaggaaatagcagaaacacaacatggaacaatagttatcagagtgcaatatgaaggggacggctctccatgcaagatcccttttgagataatggatttggaaaaaagacatgtcttaggtcgcctgattacagtcaacccaattgtgacagaaaaagatagcccagtcaacatagaagcagaacctccattcggagacagctacatcatcataggagtagagccgggacaactgaagctcaactggtttaagaaaggaagttctatcggccaaatgtttgagacaacaatgaggggggcgaagagaatggccattttaggtgacacagcctgggattttggatccttgggaggagtgtttacatctataggaaaggctctccaccaagtctttggagcaatctatggagctgccttcagtggggtttcatggactatgaaaatcctcataggagtcattatcacatggataggaatgaattcacgcagcacctcactgtctgtgacactagtattggtgggaattgtgacactgtatttgggagtcatggtgcaggcctaa

SEQ ID NO: 303 - DNA, 2385 bp, Artificial Sequence
  Synthetic
atgaaaaacccaaaaaagaaatccggaggattccggattgtcaatatgctaaaacgcggagtagcccgtgtgagcccctttgggggcttgaagaggctgccagccggacttctgctgggtcatgggcccatcaggatggtcttggcgattctagcctttttgagattcacggcaatcaagccatcactgggtctcatcaatagatggggttcagtggggaaaaaagaggctatggaaataataaagaagttcaagaaagatctggctgccatgctgagaataatcaatgctaggaaggagaagaagagacgaggcgcagatactagtgtcggaattgttggcctcctgctgaccacagctatggcagcggaggtcactagacgtgggagtgcatactatatgtacttggacagaaacgacgctggggaggccatatcttttccaaccacattggggatgaataagtgttatatacagatcatggatcttggacacatgtgtgatgccaccatgagctatgaatgccctatgctggatgagggggtggaaccagatgacgtcgattgttggtgcaacacgacgtcaacttgggttgtgtacggaacctgccatcacaaaaaaggtgaagcacggagatctagaagagctgtgacgctcccctcccattccactaggaagctgcaaacgcggtcgcaaacctggttggaatcaagagaatacacaaagcacttgattagagtcgaaaattggatattcaggaaccctggcttcgcgttagcagcagctgccatcgcttggcttttgggaagctcaacgagccaaaaagtcatatacttggtcatgatactgctgattgccccggcatacagcatcaggtgcataggagtcagcaatagggactttgtggaaggtatgtcaggtgggacttgggttgatgttgtcttggaacatggaggttgtgtcaccgtaatggcacaggacaaaccgactgtcgacatagagctggttacaacaacagtcagcaacatggcggaggtaagatcctactgctatgaggcatcaatatcggacatggcttcggacagccgctgcccaacacaaggtgaagcctaccttgacaagcaatcagacactcaatatgtctgcaaaagaacgttagtggacagaggctggggaaatggatgtggactttttggcaaagggagcctggtgacatgcgctaagtttgcatgctccaagaaaatgaccgggaagagcatccagccagagaatctggagtaccggataatgctgtcagttcatggaccaactactgtggagtcgcacggaaattactccacacaggttggagccactcaggcagcgaaggttgagataacgcccaattcaccaagagccgaagccaccctggggggttttggaagcctaggacttgattgtgaaccgaggacaggccttgacttttcagatttgtattacttgactatgaataacaagcactggttggttcacaaggagtggttccacgacattccattaccttggcacgctggggcagacaccggaactccacactggaacaacaaagaagcactggtagagttcaaggacgcacatgccaaaaggcaaactgtcgtggttctagggagtcaagaaggagcagttcacacggcccttgctggagctctggaggctgagatggatggtgcaaagggaaggctgtcctctggccacttgaaatgtcgcctgaaaatggataaacttagattgaagggcgtgtcatactccttgtgtaccgcagcgttcacattcaccaagatcccggctgaaacactgcacgggacagtcacagtggaggtacagtacgcagggacagatggaccttgcaaggttccagctcagatggcggtggacatgcaaactctgaccccagttgggaggttgataaccgctaaccccgtaatcactgaaagcactgagaactctaagatgatgctggaacttgatccaccatttggggactcttacattgtcataggagtcggggagaagaagatcacccaccactggcacaggagtggcagcaccattggaaaagcatttgaagccactgtgagaggtgccaagagaatggcagtcttgggagacacagcctgggactttggatcagttggaggcgctctcaactcattgggcaagggcatccatcaaatttttggagcagctttcaaatcattgtttggaggaatgtcctggttctcacaaattctcattggaacgttgctgatgtggttgggtctgaacacaaagaatggatctatttcccttatgtgcttggccttagggggagtgttgatcttcttatccacagctgtctctgcttaa

SEQ ID NO: 304 - DNA, 2370 bp, Artificial Sequence
  Synthetic
atgaaaaacccaaaaaagaaatccggaggattccggattgtcaatatgctaaaacgcggagtagcccgtgtgagcccctttgggggcttgaagaggctgccagccggacttctgctgggtcatgggcccatcaggatggtcttggcgattctagcctttttgagattcacggcaatcaagccatcactgggtctcatcaatagatggggttcagtggggaaaaaagaggctatggaaataataaagaagttcaagaaagatctggctgccatgctgagaataatcaatgctaggaaggagaagaagagacgaggcgcagatactagtgtcggaattgttggcctcctgctgaccacagctatggcagcggaggtcactagacgtgggagtgcatactatatgtacttggacagaaacgacgctggggaggccatatcttttccaaccacattggggatgaataagtgttatatacagatcatggatcttggacacatgtgtgatgccaccatgagctatgaatgccctatgctggatgagggggtggaaccagatgacgtcgattgttggtgcaacacgacgtcaacttgggttgtgtacggaacctgccatcacaaaaaaggtgaagcacggagatctagaagagctgtgacgctcccctcccattccactaggaagctgcaaacgcggtcgcaaacctggttggaatcaagagaatacacaaagcacttgattagagtcgaaaattggatattcaggaaccctggcttcgcgttagcagcagctgccatcgcttggcttttgggaagctcaacgagccaaaaagtcatatacttggtcatgatactgctgattgccccggcatacagcatcaggtgcataggagtcagcaatagggactttgtggaaggtatgtcaggtgggacttgggttgatgttgtcttggaacatggaggttgtgtcaccgtaatggcacaggacaaaccgactgtcgacatagagctggttacaacaacagtcagcaacatggcggaggtaagatcctactgctatgaggcatcaatatcggacatggcttcggacagccgctgcccaacacaaggtgaagcctaccttgacaagcaatcagacactcaatatgtctgcaaaagaacgttagtggacagaggctggggaaatggatgtggactttttggcaaagggagcctggtgacatgcgctaagtttgcatgctccaagaaaatgaccgggaagagcatccagccagagaatctggagtaccggataatgctgtcagttcatactggagatcagcaccaggtgggaaatgagactacagaacatggagcgaaggttgagataacgcccaattcaccaagagccgaagccaccctggggggttttggaagcctaggacttgattgtgaaccgaggacaggccttgacttttcagatttgtattacttgactatgaataacaagcactggttggttcacaaggagtggttccacgacattccattaccttggcacgctggggcagacaccggaactccacactggaacaacaaagaagcactggtagagttcaaggacgcacatgccaaaaggcaaactgtcgtggttctagggagtcaagaaggagcagttcacacggcccttgctggagctctggaggctgagatggatggtgcaaagggaaggctgtcctctggccacttgaaatgtcgcctgaaaatggataaacttagattgaagggcgtgtcatactccttgtgtaccgcagcgttcacattcaccaagatcccggctgaaacactgcacgggacagtcacagtggaggtacagtacgcagggacagatggaccttgcaaggttccagctcagatggcggtggacatgcaaactctgaccccagttgggaggttgataaccgctaaccccgtaatcactgaaagcactgagaactctaagatgatgctggaacttgatccaccatttggggactcttacattgtcataggagtcggggagaagaagatcacccaccactggcacaggagtggcagcaccattggaaaagcatttgaagccactgtgagaggtgccaagagaatggcagtcttgggagacacagcctgggactttggatcagttggaggcgctctcaactcattgggcaagggcatccatcaaatttttggagcagctttcaaatcattgtttggaggaatgtcctggttctcacaaattctcattggaacgttgctgatgtggttgggtctgaacacaaagaatggatctatttcccttatgtgcttggccttagggggagtgttgatcttcttatccacagctgtctctgcttaa

SEQ ID NO: 305 - DNA, 2370 bp, Artificial Sequence
  Synthetic
atgaaaaacccaaaaaagaaatccggaggattccggattgtcaatatgctaaaacgcggagtagcccgtgtgagcccctttgggggcttgaagaggctgccagccggacttctgctgggtcatgggcccatcaggatggtcttggcgattctagcctttttgagattcacggcaatcaagccatcactgggtctcatcaatagatggggttcagtggggaaaaaagaggctatggaaataataaagaagttcaagaaagatctggctgccatgctgagaataatcaatgctaggaaggagaagaagagacgaggcgcagatactagtgtcggaattgttggcctcctgctgaccacagctatggcagcggaggtcactagacgtgggagtgcatactatatgtacttggacagaaacgacgctggggaggccatatcttttccaaccacattggggatgaataagtgttatatacagatcatggatcttggacacatgtgtgatgccaccatgagctatgaatgccctatgctggatgagggggtggaaccagatgacgtcgattgttggtgcaacacgacgtcaacttgggttgtgtacggaacctgccatcacaaaaaaggtgaagcacggagatctagaagagctgtgacgctcccctcccattccactaggaagctgcaaacgcggtcgcaaacctggttggaatcaagagaatacacaaagcacttgattagagtcgaaaattggatattcaggaaccctggcttcgcgttagcagcagctgccatcgcttggcttttgggaagctcaacgagccaaaaagtcatatacttggtcatgatactgctgattgccccggcatacagcatcaggtgcataggagtcagcaatagggactttgtggaaggtatgtcaggtgggacttgggttgatgttgtcttggaacatggaggttgtgtcaccgtaatggcacaggacaaaccgactgtcgacatagagctggttacaacaacagtcagcaacatggcggaggtaagatcctactgctatgaggcatcaatatcggacatggcttcggacagccgctgcccaacacaaggtgaagcctaccttgacaagcaatcagacactcaatatgtctgcaaaagaacgttagtggacagaggctggggaaatggatgtggactttttggcaaagggagcctggtgacatgcgctaagtttgcatgctccaagaaaatgaccgggaagagcatccagccagagaatctggagtaccggataatgctgtcagttcattcaggggaagagcatgcagtcggaaatgacacaggaaaacatggcgcgaaggttgagataacgcccaattcaccaagagccgaagccaccctggggggttttggaagcctaggacttgattgtgaaccgaggacaggccttgacttttcagatttgtattacttgactatgaataacaagcactggttggttcacaaggagtggttccacgacattccattaccttggcacgctggggcagacaccggaactccacactggaacaacaaagaagcactggtagagttcaaggacgcacatgccaaaaggcaaactgtcgtggttctagggagtcaagaaggagcagttcacacggcccttgctggagctctggaggctgagatggatggtgcaaagggaaggctgtcctctggccacttgaaatgtcgcctgaaaatggataaacttagattgaagggcgtgtcatactccttgtgtaccgcagcgttcacattcaccaagatcccggctgaaacactgcacgggacagtcacagtggaggtacagtacgcagggacagatggaccttgcaaggttccagctcagatggcggtggacatgcaaactctgaccccagttgggaggttgataaccgctaaccccgtaatcactgaaagcactgagaactctaagatgatgctggaacttgatccaccatttggggactcttacattgtcataggagtcggggagaagaagatcacccaccactggcacaggagtggcagcaccattggaaaagcatttgaagccactgtgagaggtgccaagagaatggcagtcttgggagacacagcctgggactttggatcagttggaggcgctctcaactcattgggcaagggcatccatcaaatttttggagcagctttcaaatcattgtttggaggaatgtcctggttctcacaaattctcattggaacgttgctgatgtggttgggtctgaacacaaagaatggatctatttcccttatgtgcttggccttagggggagtgttgatcttcttatccacagctgtctctgcttaa

SEQ ID NO: 306 - DNA, 2376 bp, Artificial Sequence
  Synthetic
atgtctaagaaaccaggagggccctgcaagagccgggctgtcaatatgctaaaacgcggaatgccccgcgtgttgtccttgattggactgaagagggctatgttgagcctgatcgacggcaaggggccaatacgatttgtgttggctctcttggcgttcttcaggttcacagcaattgctccgacccgagcagtgctggatcgatggagaggtgtgaacaaacaaacagcgatgaaacaccttctgagttttaagaaggaactagggaccttgaccagtgctatcaatcggcggagctcaaaacaaaagaaaagaggaggaaagaccggaattgcagtcatgattggcctgatcgccagcgtaggagcagttaccctctctaacttccaagggaaggtgatgatgacggtaaatgctactgacgtcacagatgtcatcacgattccaacagctgctggaaagaacctatgcattgtcagagcaatggatgtgggatacatgtgcgatgatactatcacttatgaatgcccagtgctgtcggctggtaatgatccagaagacatcgactgttggtgcacaaagtcagcagtctacgtcaggtatggaagatgcaccaagacacgccactcaagacgcagtcggaggtcactgacagtgcagacacacggagaaagcactctagcgaacaagaagggggcttggatggacagcaccaaggccacaaggtatttggtaaaaacagaatcatggatcttgaggaaccctggatatgccctggtggcagccgtcattggttggatgcttgggagcaacaccatgcagagagttgtgtttgtcgtgctattgcttttggtggccccagcttacagcttcaactgccttggaatgagcaacagagacttcttggaaggagtgtctggagcaacatgggtggatttggttctcgaaggcgacagctgcgtgactatcatgtctaaggacaagcctaccatcgatgtgaagatgatgaatatggaggcggccaacctggcagaggtccgcagttattgctatttggctaccgtcagcgatctctccaccaaagctgcgtgcccgaccatgggagaagctcacaatgacaaacgtgctgacccagcttttgtgtgcagacaaggagtggtggacaggggctggggcaacggctgcggactatttggcaaaggaagcattgacacatgcgccaaatttgcctgctctaccaaggcaataggaagaaccatcttgaaagagaatatcaagtacgaagtggccatttttgtccatggctcccagcacagtgggatgatcgttaatgacacaggacatgaaactgatgagaatagagggagattcagcatcactcctgcggcgccttcatacacactaaagcttggagaatatggagaggtgacagtggactgtgaaccacggtcagggattgacaccaatgcatactacgtgatgactgttggaacaaagacgttcttggtccatcgtgagtggttcatggacctcaacctcccttggagcagtgctggaagtactgtgtggaggaacagagagacgttaatggagtttgaggaaccacacgccacgaagcagtctgtgatagcattgggctcacaagagggagctctgcatcaagctttggctggagccattcctgtggaattttcaagcaacactgtcaagttgacgtcgggtcatttgaagtgtagagtgaagatggaaaaattgcagtcgaagggaacaacctatggcgtctgttcaaaggctttcaagtttcttgggactcccgcagacacaggtcacggcactgtggtgttggaattgcagtacactggcacggatggaccttgcaaagttcctatctcgtcagtggcttcattgaacgacctaacgccagtgggcagattggtcactgtcaacccttttgtttcagtggccacggccaacgctaaggtcctgattgaattggaaccaccctttggagactcatacatagtggtgggcagaggagaacaacagatcaatcaccattggcacaagtctggaagcagcattggcaaagcctttacaaccaccctcaaaggagcgcagagactagccgctctaggagacacagcttgggactttggatcagttggaggggtgttcacctcagttgggaaggctgtccatcaagtgttcggaggagcattccgctcactgttcggaggcatgtcctggataacgcaaggattgctgggggctctcctgttgtggatgggcatcaatgctcgtgataggtccatagctctcacgtttctcgcagttggaggagttctgctcttcctctccgtgaacgtgcacgcttaa

SEQ ID NO: 307 - DNA, 2343 bp, Artificial Sequence
  Synthetic
atgatcaaccaacgaaaaaagacgggtcgaccgtctttcaatatgctgaaacgcgcgagaaaccgcgtgtcaactgtttcacagttggcgaagagattctcaaaaggattgctctcaggccaaggacccatgaaattggtgatggctttcatagcattcttaagatttctagccatacccccaacagcaggaattttggctagatggggctcattcaagaagaatggagcgattaaagtgttacggggtttcaagagagaaatctcaaacatgctaaacataatgaacaggaggaaaagatccgtgaccatgctccttatgctgctgcccacagccctggcgttccatctgacgacacgagggggagagccgcatatgatagttagcaagcaggaaagaggaaagtcacttttgttcaagacctctgcaggtgtcaacatgtgcaccctcattgcgatggatttgggagagttgtgtgaggacacgatgacctacaaatgcccccggatcactgaggcggaaccagatgacgttgactgttggtgcaatgccacggacacatgggtgacctatggaacgtgctctcaaactggcgaacaccgacgagacaaacgttccgtcgcattggccccacacgtggggcttggcctagaaacaagagccgaaacgtggatgtcctctgaaggtgcttggaaacagatacaaaaagtagagacttgggctctgagacatccaggattcacggtgatagccctttttctagcacatgccataggaacatccatcacccagaaagggatcattttcattttgctgatgctggtaacaccatctatggccatgcgatgcgtgggaataggcaacagagacttcgtggaaggactgtcaggagcaacatgggtggatgtggtactggagcatggaagttgcgtcaccaccatggcaaaaaacaaaccaacactggacattgaactcttgaagacggaggtcacaaaccctgcagttctgcgtaaattgtgcattgaagctaaaatatcaaacaccaccaccgattcgagatgtccaacacaaggagaagccacactggtggaagaacaagacgcgaactttgtgtgccgacgaacgttcgtggacagaggctggggcaatggctgtgggctattcggaaaaggtagtctaataacgtgtgccaagtttaagtgtgtgacaaaactagaaggaaagatagttcaatatgaaaacctaaaatattcagtgatagtcaccgtccacggctcccagcacagtgggatgatcgttaatgacacaggacatgaaactgatgagaatagaacaactgcaaccataacacctcaagctcctacgtcggaaatacagctgaccgactacggaacccttacattagattgttcacctaggacagggctagattttaacgagatggtgttgctgacaatgaaagaaagatcatggcttgtccacaaacaatggtttctagacttaccactgccttggacctctggggcttcaacatcccaagagacttggaacagacaagatttactggtcacatttaagacagctcatgcaaagaagcaggaagtagtcgtactaggatcacaagaaggagcaatgcacactgcgctgactggagcgacagaaatccaaacgtcaggaacgacaacaattttcgcaggacacctaaaatgcagactaaaaatggacaaactaactttaaaagggatgtcatatgtgatgtgcacaggctcattcaagttagagaaagaagtggctgagacccagcatggaactgttctggtgcaggttaaatatgaaggaacagacgcaccatgcaagattcccttttcgacccaagatgagaaaggagcaacccagaatgggagattaataacagccaaccccatagtcactgacaaagaaaaaccagtcaatattgaggcagaaccaccctttggtgagagctacatcgtggtaggagcaggtgaaaaagctttgaaactaagctggttcaagaaaggaagcagcatagggaaaatgtttgaagcaactgcccgaggagcacgaaggatggccattctgggagacaccgcatgggacttcggttctataggaggagtgttcacgtctatgggaaaactggtacaccaggtttttggaactgcatatggagttttgtttagcggagtttcttggaccatgaaaataggaatagggattctgctgacatggctaggattaaattcaaggaacacgtccctttcgatgatgtgcatcgcagttggcatggtcacactgtacctaggagtcatggttcaggcataa

SEQ ID NO: 308 - DNA, 2343 bp, Artificial Sequence
  Synthetic
atgaataaccaacggaaaaaggcgaaaaacacgcctttcaatatgctgaaacgcgagagaaaccgcgtgtcgactgtgcaacagctgacaaagagattctcacttggaatgctgcagggacgaggaccattaaaactgttcatggccctggtggcgttccttcgtttcctaacaatcccaccaacagcagggatattgaagagatggggaacaattaaaaaatcaaaagctattaatgttttgagagggttcaggaaagagattggaaggatgctgaacatcttgaataggagacgcagatctgcaggcatgatcattatgctgattccaacagtgatggcgttccatttaaccacacgtaacggagaaccacacatgatcgtcagcagacaagagaaagggaaaagtcttctgtttaaaacagaggatggcgtgaacatgtgtaccctcatggccatggaccttggtgaattgtgtgaagacacaatcacgtacaagtgtccccttctcaggcagaatgagccagaagacatagactgttggtgcaactctacgtccacgtgggtaacttatgggacgtgtaccaccatgggagaacatagaagagaaaaaagatcagtggcactcgttccacatgtgggaatgggactggagacacgaactgaaacatggatgtcatcagaaggggcctggaaacatgtccagagaattgaaacttggatcttgagacatccaggcttcaccatgatggcagcaatcctggcatacaccataggaacgacacatttccaaagagccctgattttcatcttactgacagctgtcactccttcaatgacaatgcgttgcataggaatgtcaaatagagactttgtggaaggggtttcaggaggaagctgggttgacatagtcttagaacatggaagctgtgtgacgacgatggcaaaaaacaaaccaacattggattttgaactgataaaaacagaagccaaacagcctgccaccctaaggaagtactgtatagaggcaaagctaaccaacacaacaacagaatctcgctgcccaacacaaggggaacccagcctaaatgaagagcaggacaaaaggttcgtctgcaaacactccatggtagacagaggatggggaaatggatgtggactatttggaaagggaggcattgtgacctgtgctatgttcagatgcaaaaagaacatggaaggaaaagttgtgcaaccagaaaacttggaatacaccattgtgataacacctcacggctcccagcacagtgggatgatcgttaatgacacaggacatgaaactgatgagaatagaaaggaaatcaaaataacaccacagagttccatcacagaagcagaattgacaggttatggcactgtcacaatggagtgctctccaagaacgggcctcgacttcaatgagatggtgttgttgcagatggaaaataaagcttggctggtgcacaggcaatggttcctagacctgccgttaccatggttgcccggagcggacacacaagggtcaaattggatacagaaagagacattggtcactttcaaaaatccccatgcgaagaaacaggatgttgttgttttaggatcccaagaaggggccatgcacacagcacttacaggggccacagaaatccaaatgtcatcaggaaacttactcttcacaggacatctcaagtgcaggctgagaatggacaagctacagctcaaaggaatgtcatactctatgtgcacaggaaagtttaaagttgtgaaggaaatagcagaaacacaacatggaacaatagttatcagagtgcaatatgaaggggacggctctccatgcaagatcccttttgagataatggatttggaaaaaagacatgtcttaggtcgcctgattacagtcaacccaattgtgacagaaaaagatagcccagtcaacatagaagcagaacctccattcggagacagctacatcatcataggagtagagccgggacaactgaagctcaactggtttaagaaaggaagttctatcggccaaatgtttgagacaacaatgaggggggcgaagagaatggccattttaggtgacacagcctgggattttggatccttgggaggagtgtttacatctataggaaaggctctccaccaagtctttggagcaatctatggagctgccttcagtggggtttcatggactatgaaaatcctcataggagtcattatcacatggataggaatgaattcacgcagcacctcactgtctgtgacactagtattggtgggaattgtgacactgtatttgggagtcatggtgcaggcctaa

SEQ ID NO: 309 - DNA, 2385 bp, Artificial Sequence; identical to SEQ ID NO: 284
  Synthetic

SEQ ID NO: 310 - DNA, 2091 bp, Artificial Sequence; identical to SEQ ID NO: 285
  Synthetic

SEQ ID NO: 311 - DNA, 2385 bp, Artificial Sequence; identical to SEQ ID NO: 286
  Synthetic

SEQ ID NO: 312 - DNA, 2091 bp, Artificial Sequence; identical to SEQ ID NO: 287
  Synthetic

SEQ ID NO: 313 - DNA, 2373 bp, Artificial Sequence; identical to SEQ ID NO: 288
  Synthetic

SEQ ID NO: 314 - DNA, 2079 bp, Artificial Sequence; identical to SEQ ID NO: 289
  Synthetic

SEQ ID NO: 315 - DNA, 2385 bp, Artificial Sequence; identical to SEQ ID NO: 290
  Synthetic

SEQ ID NO: 316 - DNA, 2091 bp, Artificial Sequence; identical to SEQ ID NO: 291
  Synthetic

SEQ ID NO: 317 - DNA, 2385 bp, Artificial Sequence; identical to SEQ ID NO: 292
  Synthetic

SEQ ID NO: 318 - DNA, 2091 bp, Artificial Sequence; identical to SEQ ID NO: 293
  Synthetic

SEQ ID NO: 319 - DNA, 2385 bp, Artificial Sequence; identical to SEQ ID NO: 294
  Synthetic

SEQ ID NO: 320 - DNA, 2091 bp, Artificial Sequence; identical to SEQ ID NO: 295
  Synthetic

SEQ ID NO: 321 - DNA, 2091 bp, Artificial Sequence; identical to SEQ ID NO: 283
  Synthetic

SEQ ID NO: 322 - DNA, 1443 bp, Artificial Sequence
  Synthetic
atgggcaagcggtccgccggctctatcatgtggctggcctctctggccgtggtcatcgcatgcgcaggagcaatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggtcgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgtga

SEQ ID NO: 323 - DNA, 2082 bp, Artificial Sequence
  Synthetic
atgggcaagcggtccgccggctctatcatgtggctggcctctctggccgtggtcatcgcatgcgcaggagcaaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggtcgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccaccctgggcaaggcctttagcaccaccctgaagggagcacagaggctggccgccctgggcgacaccgcatgggatttcggctccatcggaggcgtgttcaactctatcggcaaggccgtgcaccaggtgttcggcggcgcctttcggaccctgttcggcggcatgtcttggatcacccagggcctgatgggcgccctgctgctgtggatgggcgtgaacgcccgggaccggtctatcgccctggccttcctggccaccggaggcgtgctggtgttcctggccaccaacgtgcacgcctga

SEQ ID NO: 324 - DNA, 2091 bp, Artificial Sequence
  Synthetic
atgggcaagcggtccgccggctctatcatgtggctggcctctctggccgtggtcatcgcatgcgcaggagcagcggaggtcaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggtcgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 325 - DNA, 2091 bp, Artificial Sequence
  Synthetic
atgggcaagcggtccgccggctctatcatgtggctggcctctctggccgtggtcatcgcatgcgcaggagcagcggaggtcaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccaccctgggcaaggcctttagcaccaccctgaagggagcacagaggctggccgccctgggcgacaccgcatgggatttcggctccatcggaggcgtgttcaactctatcggcaaggccgtgcaccaggtgttcggcggcgcctttcggaccctgttcggcggcatgtcttggatcacccagggcctgatgggcgccctgctgctgtggatgggcgtgaacgcccgggaccggtctatcgccctggccttcctggccaccggaggcgtgctggtgttcctggccaccaacgtgcacgcctga

SEQ ID NO: 326 - DNA, 2082 bp, Artificial Sequence; identical to SEQ ID NO: 323
  Synthetic

SEQ ID NO: 327 - DNA, 2091 bp, Artificial Sequence
  Synthetic
atgggcaagcggtccgccggctctatcatgtggctggcctctctggccgtggtcatcgcatgcgcaggagcagcggaggtcaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggtcgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccaccctgggcaaggcctttagcaccaccctgaagggagcacagaggctggccgccctgggcgacaccgcatgggatttcggctccatcggaggcgtgttcaactctatcggcaaggccgtgcaccaggtgttcggcggcgcctttcggaccctgttcggcggcatgtcttggatcacccagggcctgatgggcgccctgctgctgtggatgggcgtgaacgcccgggaccggtctatcgccctggccttcctggccaccggaggcgtgctggtgttcctggccaccaacgtgcacgcctga

SEQ ID NO: 328 - DNA, 2091 bp, Artificial Sequence; identical to SEQ ID NO: 325
  Synthetic

SEQ ID NO: 329 - DNA, 2091 bp, Artificial Sequence
  Synthetic
atgggcaagcggtccgccggctctatcatgtggctggcctctctggccgtggtcatcgcatgcgcaggagcagcggaggtcaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgtcttcaactctctgggcaagggcatccaccagatcttcggcgccgcctttaagtccctgttcggcggcatgtcttggtttagccagatcctgatcggcacactgctggtgtggctgggcctgaacaccaagaatggctctatcagcctgacgtgcctggccctgggaggcgtgatgatcttcctgagcaccgccgtgtccgcctga

SEQ ID NO: 330 - DNA, 2091 bp, Artificial Sequence
  Synthetic
atgggcaagcggtccgccggctctatcatgtggctggcctctctggccgtggtcatcgcatgcgcaggagcagcggaggtcaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggtagcagtagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgtcttcaactctctgggcaagggcatccaccagatcttcggcgccgcctttaagtccctgttcggcggcatgtcttggtttagccagatcctgatcggcacactgctggtgtggctgggcctgaacaccaagaatggctctatcagcctgacgtgcctggccctgggaggcgtgatgatcttcctgagcaccgccgtgtccgcctga

SEQ ID NO: 331 - DNA, 2091 bp, Artificial Sequence
  Synthetic
atgggcaagcggtccgccggctctatcatgtggctggcctctctggccgtggtcatcgcatgcgcaggagcagcggaggtcaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatcaaggtggagaactggatctttagaaatccaggattcgcactggtagcagtagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgtcttcaactctctgggcaagggcatccaccagatcttcggcgccgcctttaagtccctgttcggcggcatgtcttggtttagccagatcctgatcggcacactgctggtgtggctgggcctgaacaccaagaatggctctatcagcctgacgtgcctggccctgggaggcgtgatgatcttcctgagcaccgccgtgtccgcctga

SEQ ID NO: 332 - DNA, 2091 bp, Artificial Sequence
  Synthetic
atgcccatgggcagcctgcagcccctggccaccctgtacctgctgggcatgctggtggctagcgtgctggccgcggaggtcaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccaccctgggcaaggcctttagcaccaccctgaagggagcacagaggctggccgccctgggcgacaccgcatgggatttcggctccatcggaggcgtgttcaactctatcggcaaggccgtgcaccaggtgttcggcggcgcctttcggaccctgttcggcggcatgtcttggatcacccagggcctgatgggcgccctgctgctgtggatgggcgtgaacgcccgggaccggtctatcgccctggccttcctggccaccggaggcgtgctggtgttcctggccaccaacgtgcacgcctga

SEQ ID NO: 333 - DNA, 2091 bp, Artificial Sequence
  Synthetic
atgcccatgggcagcctgcagcccctggccaccctgtacctgctgggcatgctggtggctagcgtgctggccgcggaggtcaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 334 - DNA, 2091 bp, Artificial Sequence
  Synthetic
atgcccatgggcagcctgcagcccctggccaccctgtacctgctgggcatgctggtggctagcgtgctggccgcggaggtcaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggtcgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 335 - DNA, 2091 bp, Artificial Sequence
  Synthetic
atgcccatgggcagcctgcagcccctggccaccctgtacctgctgggcatgctggtggctagcgtgctggccgccgaggtgacccggagaggcagcgcctactatatgtacctggaccggaatgatgccggcgaggccatctcctttcccaccacactgggcatgaacaagtgctacatccagatcatggacctgggccacatgtgcgatgccaccatgagctatgagtgtccaatgctggacgagggcgtggagcccgacgatgtggattgctggtgtaataccacatctacatgggtggtgtacggcacctgtcaccacaagaagggagaggcaaggcgcagccggagagcagtgacactgccttcccactctacccggaagctgcagacaagaagccagacctggctggagtccagggagtatacaaagcacctgatccgggtggagaactggatctttagaaatccaggattcgcactggcagcagcagcaatcgcatggctgctgggcagctccaccagccagaaagtgatctacctggtcatgatcctgctgatcgcccctgcctattctatcaggtgcatcggcgtgagcaatagggacttcgtggagggaatgtccggaggcacctgggtggatgtggtgctggagcacggcggctgcgtgacagtgatggcccaggacaagccaaccgtggacatcgagctggtgaccacaaccgtgtccaacatggccgaggtgcggtcttactgctatgaggccagcatctccgacatggcctctgatagcagatgtcccacccagggcgaggcctacctggacaagcagtccgatacacagtacgtgtgcaagaggaccctggtggacaggggatggggaaatggatgtggcctgtttggcaagggctctctggtgacatgcgccaagttcgcctgtagcaagaagatgaccggcaagtccatccagccagagaacctggagtacaggatcatgctgtctgtgcacggctcccagcactctggcatgatcgtgaacgacacaggccacgagacagatgagaatagggccaaggtggagatcacacctaactccccacgcgccgaggccaccctgggaggatttggctctctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggccggctgatcaccgcaaatccagtgatcacagagtctaccgagaacagcaagatgatgctggagctggaccccccttttggcgatagctatatcgtgatcggcgtgggcgagaagaagatcacacaccactggcacagaagcggctccacaatcggcaaggcctttgaggccaccgtgaggggagcaaagaggatggccgtgctgggcgacaccgcatgggatttcggctctgtgggaggcgccctgaacagcctgggcaagggcatccaccagatcttcggcgccgcctttaagtccctgttcggcggcatgagctggttttcccagatcctgatcggcacactgctgatgtggctgggcctgaacaccaagaatggctctatcagcctgatgtgcctggccctgggaggcgtgctgatcttcctgtccaccgccgtgtccgcctga

SEQ ID NO: 336 - DNA, 2091 bp, Artificial Sequence
  Synthetic
atgggaaagaggtctgccgggagtattatgtggctggcttcactggctgtcgtcatcgcctgtgctggagctgctgaggtcactaggcggggctccgcctactatatgtatctagacagaaatgatgccggcgaggccatctcttttcccaccacactgggcatgaacaagtgctacatccagatcatggacctgggccacatgtgcgatgccaccatgagctatgagtgtccaatgctggacgagggcgtggagcccgacgatgtggattgctggtgtaataccacaagcacatgggtggtgtacggcacctgtcaccacaagaagggagaggcacggagatccaggagggcagtgacactgccttcccactctaccaggaagctgcagacacgctcccagacctggctggagtccagagagtataccaagcacctgatcagggtggagaactggatctttcgcaatccaggattcgcactggctgccgccgccatcgcatggctgctgggcagctccacctcccagaaagtgatctacctggtcatgatcctgctgatcgcccctgcctatagcatccggtgcatcggcgtgtccaatagagacttcgtggagggcatgtctggcggcacctgggtggatgtggtgctggagcacggcggctgcgtgacagtgatggcccaggacaagccaaccgtggatatcgagctggtgaccacaaccgtgtctaacatggccgaggtgcggagctactgctatgaggccagcatctccgacatggcctctgatagcagatgtcccacccagggcgaggcctacctggacaagcagtctgatacacagtacgtgtgcaagcggaccctggtggacagaggctggggcaatggctgtggcctgtttggcaagggcagcctggtgacatgcgccaagttcgcctgttccaagaagatgaccggcaagtctatccagccagagaacctggagtacaggatcatgctgagcgtgcacggctcccagcactctggcatgatcgtgaacgacacaggccacgagacagatgagaatagggccaaggtggagatcacacctaactctccaagggcagaggccaccctgggaggatttggcagcctgggcctggactgcgagcctaggacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggctcccaggagggagcagtgcacaccgccctggcaggcgccctggaggccgagatggacggagcaaagggccgcctgtctagcggccacctgaagtgcaggctgaagatggataagctgcgcctgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggccggctgatcaccgcaaatccagtgatcacagagtctaccgagaacagcaagatgatgctggagctggaccccccttttggcgatagctatatcgtgatcggcgtgggcgagaagaagatcacacaccactggcacagaagcggctccacaatcggcaaggcctttgaggcaaccgtgcggggagcaaagagaatggccgtgctgggcgacaccgcatgggatttcggcagcgtgggaggcgccctgaactccctgggcaagggcatccaccagatcttcggcgccgcctttaagtccctgttcggcggcatgagctggttctcccagatcctgatcggcacactgctgatgtggctgggcctgaacaccaagaatggctctatcagcctgatgtgcctggctctgggaggggtcctgattttcctgtctaccgccgtgtccgcttga

SEQ ID NO: 337 - DNA, 2091 bp, Artificial Sequence
  Synthetic
atgggaaagaggtctgccgggagtattatgtggctggcttcactggctgtcgtcatcgcctgtgctggagctgctgaggtcactaggcggggctccgcctactatatgtatctagacagaaatgatgccggcgaggtgatctcttttcccaccacactgggcatgaacaagtgctacatccagatcatggacctgggccacatgtgcgatgccaccatgagctatgagtgtccaatgctggacgagggcgtggagcccgacgatgtggattgctggtgtaatacctccagcacatgggtggtgtacggcacctgtcaccacaagaagggagaggcacggagatccaggagggcagtgacactgccttcccactctaccaggaagctgcagacacgctcccagacctggctggagtccagagagtataccaagcacctgatcagggtggagaactggatctttcgcaatccaggattcgcactggctgccgccgccatcgcatggctgctgggcagctccacctcccagaaagtgatctacctggtcatgatcctgctgatcgcccctgcctatagcatccggtgcatcggcgtgtccaatagagacttcgtggagggcatgtctggcggcacctgggtggatgtggtgctggagcacggcggctgcgtgacagtgatggcccaggacaagccaaccgtggatatcgagctggtgaccacaaccgtgtctaacatggccgaggtgcggagctactgctatgaggccagcatctccgacatggcctctgatagcagatgtcccacccagggcgaggcctacctggacaagcagtctgatacacagtacgtgtgcaagcggaccctggtggacagaggctggggcaatggctgtggcctgtttggcaagggcagcctggtgacatgcgccaagttcgcctgttccaagaagatgaccggcaagtctatccagccagagaacctggagtacaggatcatgctgagcgtgcacggctcccagcactctggcatgatcgtgaacgacacaggccacgagacagatgagaatagggccaaggtggagatcacacctaactctccaagggcagaggccaccctgggaggatttggcagcctgggcctggactgcgagcctaggacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggctcccaggagggagcagtgcacaccgccctggcaggcgccctggaggccgagatggacggagcaaagggccgcctgtctagcggccacctgaagtgcaggctgaagatggataagctgcgcctgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggccggctgatcaccgcaaatccagtgatcacagagtctaccgagaacagcaagatgatgctggagctggaccccccttttggcgatagctatatcgtgatcggcgtgggcgagaagaagatcacacaccactggcacagaagcggctccacaatcggcaaggcctttgaggcaaccgtgcggggagcaaagagaatggccgtgctgggcgacaccgcatgggatttcggcagcgtgggaggcgccctgaactccctgggcaagggcatccaccagatcttcggcgccgcctttaagtccctgttcggcggcatgagctggttctcccagatcctgatcggcacactgctgatgtggctgggcctgaacaccaagaatggctctatcagcctgatgtgcctggctctgggaggggtcctgattttcctgtctaccgccgtgtccgcttga

SEQ ID NO: 338 - DNA, 2091 bp, Artificial Sequence
  Synthetic
atgggaaagaggtctgccgggagtattatgtggctggcttcactggctgtcgtcatcgcctgtgctggagctgctgaggtcactaggcggggctccgcctactatatgtatctagacagaaatgatgccggcgaggccatctcttttcccaccacactgggcatgaacaagtgctacatccagatcatggacctgggccacatgtgcgatgccaccatgagctatgagtgtccaatgctggacgagggcgtggagcccgacgatgtggattgctggtgtaataccacaagcacatgggtggtgtacggcacctgtcaccacaagaagggagagcgacggagacgtaggagggcagtgacactgccttcccactctaccaggaagctgcagacacgctcccagacctggctggagtccagagagtataccaagcacctgatcagggtggagaactggatctttcgcaatccaggattcgcactggctgccgccgccatcgcatggctgctgggcagctccacctcccagaaagtgatctacctggtcatgatcctgctgatcgcccctgcctatagcatccggtgcatcggcgtgtccaatagagacttcgtggagggcatgtctggcggcacctgggtggatgtggtgctggagcacggcggctgcgtgacagtgatggcccaggacaagccaaccgtggatatcgagctggtgaccacaaccgtgtctaacatggccgaggtgcggagctactgctatgaggccagcatctccgacatggcctctgatagcagatgtcccacccagggcgaggcctacctggacaagcagtctgatacacagtacgtgtgcaagcggaccctggtggacagaggctggggcaatggctgtggcctgtttggcaagggcagcctggtgacatgcgccaagttcgcctgttccaagaagatgaccggcaagtctatccagccagagaacctggagtacaggatcatgctgagcgtgcacggctcccagcactctggcatgatcgtgaacgacacaggccacgagacagatgagaatagggccaaggtggagatcacacctaactctccaagggcagaggccaccctgggaggatttggcagcctgggcctggactgcgagcctaggacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggctcccaggagggagcagtgcacaccgccctggcaggcgccctggaggccgagatggacggagcaaagggccgcctgtctagcggccacctgaagtgcaggctgaagatggataagctgcgcctgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggccggctgatcaccgcaaatccagtgatcacagagtctaccgagaacagcaagatgatgctggagctggaccccccttttggcgatagctatatcgtgatcggcgtgggcgagaagaagatcacacaccactggcacagaagcggctccacaatcggcaaggcctttgaggcaaccgtgcggggagcaaagagaatggccgtgctgggcgacaccgcatgggatttcggcagcgtgggaggcgccctgaactccctgggcaagggcatccaccagatcttcggcgccgcctttaagtccctgttcggcggcatgagctggttctcccagatcctgatcggcacactgctgatgtggctgggcctgaacaccaagaatggctctatcagcctgatgtgcctggctctgggaggggtcctgattttcctgtctaccgccgtgtccgcttga

SEQ ID NO: 339 - DNA, 2091 bp, Artificial Sequence
  Synthetic
atgggaaagaggtctgccgggagtattatgtggctggcttcactggctgtcgtcatcgcctgtgctggagctgctgaggtcactaggcggggctccgcctactatatgtatctagacagaaatgatgccggcgaggccatctcttttcccaccacactgggcatgaacaagtgctacatccagatcatggacctgggccacatgtgcgatgccaccatgagctatgagtgtccaatgctggacgagggcgtggagcccgacgatgtggattgctggtgtaataccacaagcacatgggtggtgtacggcacctgtcaccacaagaagggagagaaacggagaaagaggagggcagtgacactgccttcccactctaccaggaagctgcagacacgctcccagacctggctggagtccagagagtataccaagcacctgatcagggtggagaactggatctttcgcaatccaggattcgcactggctgccgccgccatcgcatggctgctgggcagctccacctcccagaaagtgatctacctggtcatgatcctgctgatcgcccctgcctatagcatccggtgcatcggcgtgtccaatagagacttcgtggagggcatgtctggcggcacctgggtggatgtggtgctggagcacggcggctgcgtgacagtgatggcccaggacaagccaaccgtggatatcgagctggtgaccacaaccgtgtctaacatggccgaggtgcggagctactgctatgaggccagcatctccgacatggcctctgatagcagatgtcccacccagggcgaggcctacctggacaagcagtctgatacacagtacgtgtgcaagcggaccctggtggacagaggctggggcaatggctgtggcctgtttggcaagggcagcctggtgacatgcgccaagttcgcctgttccaagaagatgaccggcaagtctatccagccagagaacctggagtacaggatcatgctgagcgtgcacggctcccagcactctggcatgatcgtgaacgacacaggccacgagacagatgagaatagggccaaggtggagatcacacctaactctccaagggcagaggccaccctgggaggatttggcagcctgggcctggactgcgagcctaggacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggctcccaggagggagcagtgcacaccgccctggcaggcgccctggaggccgagatggacggagcaaagggccgcctgtctagcggccacctgaagtgcaggctgaagatggataagctgcgcctgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggccggctgatcaccgcaaatccagtgatcacagagtctaccgagaacagcaagatgatgctggagctggaccccccttttggcgatagctatatcgtgatcggcgtgggcgagaagaagatcacacaccactggcacagaagcggctccacaatcggcaaggcctttgaggcaaccgtgcggggagcaaagagaatggccgtgctgggcgacaccgcatgggatttcggcagcgtgggaggcgccctgaactccctgggcaagggcatccaccagatcttcggcgccgcctttaagtccctgttcggcggcatgagctggttctcccagatcctgatcggcacactgctgatgtggctgggcctgaacaccaagaatggctctatcagcctgatgtgcctggctctgggaggggtcctgattttcctgtctaccgccgtgtccgcttga

SEQ ID NO: 340 - DNA, 2091 bp, Artificial Sequence
  Synthetic
atgggaaagaggtctgccgggagtattatgtggctggcttcactggctgtcgtcatcgcctgtgctggagctgctgaggtcactaggcggggctccgcctactatatgtatctagacagaaatgatgccggcgaggccatctcttttcccaccacactgggcatgaacaagtgctacatccagatcatggacctgggccacatgtgcgatgccaccatgagctatgagtgtccaatgctggacgagggcgtggagcccgacgatgtggattgctggtgtaataccacaagcacatgggtggtgtacggcacctgtcaccacaagaagggagaggcacggagagcaaggagggcagtgacactgccttcccactctaccaggaagctgcagacacgctcccagacctggctggagtccagagagtataccaagcacctgatcagggtggagaactggatctttcgcaatccaggattcgcactggctgccgccgccatcgcatggctgctgggcagctccacctcccagaaagtgatctacctggtcatgatcctgctgatcgcccctgcctatagcatccggtgcatcggcgtgtccaatagagacttcgtggagggcatgtctggcggcacctgggtggatgtggtgctggagcacggcggctgcgtgacagtgatggcccaggacaagccaaccgtggatatcgagctggtgaccacaaccgtgtctaacatggccgaggtgcggagctactgctatgaggccagcatctccgacatggcctctgatagcagatgtcccacccagggcgaggcctacctggacaagcagtctgatacacagtacgtgtgcaagcggaccctggtggacagaggctggggcaatggctgtggcctgtttggcaagggcagcctggtgacatgcgccaagttcgcctgttccaagaagatgaccggcaagtctatccagccagagaacctggagtacaggatcatgctgagcgtgcacggctcccagcactctggcatgatcgtgaacgacacaggccacgagacagatgagaatagggccaaggtggagatcacacctaactctccaagggcagaggccaccctgggaggatttggcagcctgggcctggactgcgagcctaggacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggctcccaggagggagcagtgcacaccgccctggcaggcgccctggaggccgagatggacggagcaaagggccgcctgtctagcggccacctgaagtgcaggctgaagatggataagctgcgcctgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggccggctgatcaccgcaaatccagtgatcacagagtctaccgagaacagcaagatgatgctggagctggaccccccttttggcgatagctatatcgtgatcggcgtgggcgagaagaagatcacacaccactggcacagaagcggctccacaatcggcaaggcctttgaggcaaccgtgcggggagcaaagagaatggccgtgctgggcgacaccgcatgggatttcggcagcgtgggaggcgccctgaactccctgggcaagggcatccaccagatcttcggcgccgcctttaagtccctgttcggcggcatgagctggttctcccagatcctgatcggcacactgctgatgtggctgggcctgaacaccaagaatggctctatcagcctgatgtgcctggctctgggaggggtcctgattttcctgtctaccgccgtgtccgcttga

SEQ ID NO: 341 - DNA, 2091 bp, Artificial Sequence
  Synthetic
atgggaaagaggtctgccgggagtattatgtggctggcttcactggctgtcgtcatcgcctgtgctggagctgctgaggtcactaggcggggctccgcctactatatgtatctagacagaaatgatgccggcgaggccatctcttttcccaccacactgggcatgaacaagtgctacatccagatcatggacctgggccacatgtgcgatgccaccatgagctatgagtgtccaatgctggacgagggcgtggagcccgacgatgtggattgctggtgtaataccacaagcacatgggtggtgtacggcacctgtcaccacaagaagggagaggcacggggttccggaggtgcagtgacactgccttcccactctaccaggaagctgcagacacgctcccagacctggctggagtccagagagtataccaagcacctgatcagggtggagaactggatctttcgcaatccaggattcgcactggctgccgccgccatcgcatggctgctgggcagctccacctcccagaaagtgatctacctggtcatgatcctgctgatcgcccctgcctatagcatccggtgcatcggcgtgtccaatagagacttcgtggagggcatgtctggcggcacctgggtggatgtggtgctggagcacggcggctgcgtgacagtgatggcccaggacaagccaaccgtggatatcgagctggtgaccacaaccgtgtctaacatggccgaggtgcggagctactgctatgaggccagcatctccgacatggcctctgatagcagatgtcccacccagggcgaggcctacctggacaagcagtctgatacacagtacgtgtgcaagcggaccctggtggacagaggctggggcaatggctgtggcctgtttggcaagggcagcctggtgacatgcgccaagttcgcctgttccaagaagatgaccggcaagtctatccagccagagaacctggagtacaggatcatgctgagcgtgcacggctcccagcactctggcatgatcgtgaacgacacaggccacgagacagatgagaatagggccaaggtggagatcacacctaactctccaagggcagaggccaccctgggaggatttggcagcctgggcctggactgcgagcctaggacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggctcccaggagggagcagtgcacaccgccctggcaggcgccctggaggccgagatggacggagcaaagggccgcctgtctagcggccacctgaagtgcaggctgaagatggataagctgcgcctgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggccggctgatcaccgcaaatccagtgatcacagagtctaccgagaacagcaagatgatgctggagctggaccccccttttggcgatagctatatcgtgatcggcgtgggcgagaagaagatcacacaccactggcacagaagcggctccacaatcggcaaggcctttgaggcaaccgtgcggggagcaaagagaatggccgtgctgggcgacaccgcatgggatttcggcagcgtgggaggcgccctgaactccctgggcaagggcatccaccagatcttcggcgccgcctttaagtccctgttcggcggcatgagctggttctcccagatcctgatcggcacactgctgatgtggctgggcctgaacaccaagaatggctctatcagcctgatgtgcctggctctgggaggggtcctgattttcctgtctaccgccgtgtccgcttga

SEQ ID NO: 342 - DNA, 2091 bp, Artificial Sequence
  Synthetic
atgggaaagaggtctgccgggagtattatgtggctggcttcactggctgtcgtcatcgcctgtgctggagctgctgaggtcactaggcggggctccgcctactatatgtatctagacagaaatgatgccggcgaggccatctcttttcccaccacactgggcatgaacaagtgctacatccagatcatggacctgggccacatgtgcgatgccaccatgagctatgagtgtccaatgctggacgagggcgtggagcccgacgatgtggattgctggtgtaataccacaagcacatgggtggtgtacggcacctgtcaccacaagaagggagaggcatcgagatccaggagggcagtgacactgccttcccactctaccaggaagctgcagacacgctcccagacctggctggagtccagagagtataccaagcacctgatcagggtggagaactggatctttcgcaatccaggattcgcactggctgccgccgccatcgcatggctgctgggcagctccacctcccagaaagtgatctacctggtcatgatcctgctgatcgcccctgcctatagcatccggtgcatcggcgtgtccaatagagacttcgtggagggcatgtctggcggcacctgggtggatgtggtgctggagcacggcggctgcgtgacagtgatggcccaggacaagccaaccgtggatatcgagctggtgaccacaaccgtgtctaacatggccgaggtgcggagctactgctatgaggccagcatctccgacatggcctctgatagcagatgtcccacccagggcgaggcctacctggacaagcagtctgatacacagtacgtgtgcaagcggaccctggtggacagaggctggggcaatggctgtggcctgtttggcaagggcagcctggtgacatgcgccaagttcgcctgttccaagaagatgaccggcaagtctatccagccagagaacctggagtacaggatcatgctgagcgtgcacggctcccagcactctggcatgatcgtgaacgacacaggccacgagacagatgagaatagggccaaggtggagatcacacctaactctccaagggcagaggccaccctgggaggatttggcagcctgggcctggactgcgagcctaggacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggctcccaggagggagcagtgcacaccgccctggcaggcgccctggaggccgagatggacggagcaaagggccgcctgtctagcggccacctgaagtgcaggctgaagatggataagctgcgcctgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggccggctgatcaccgcaaatccagtgatcacagagtctaccgagaacagcaagatgatgctggagctggaccccccttttggcgatagctatatcgtgatcggcgtgggcgagaagaagatcacacaccactggcacagaagcggctccacaatcggcaaggcctttgaggcaaccgtgcggggagcaaagagaatggccgtgctgggcgacaccgcatgggatttcggcagcgtgggaggcgccctgaactccctgggcaagggcatccaccagatcttcggcgccgcctttaagtccctgttcggcggcatgagctggttctcccagatcctgatcggcacactgctgatgtggctgggcctgaacaccaagaatggctctatcagcctgatgtgcctggctctgggaggggtcctgattttcctgtctaccgccgtgtccgcttga

SEQ ID NO: 343 - DNA, 2091 bp, Artificial Sequence
  Synthetic
atgggaaagaggtctgccgggagtattatgtggctggcttcactggctgtcgtcatcgcctgtgctggagctgctgaggtcactaggcggggctccgcctactatatgtatctagacagaaatgatgccggcgaggccatctcttttcccaccacactgggcatgaacaagtgctacatccagatcatggacctgggccacatgtgcgatgccaccatgagctatgagtgtccaatgctggacgagggcgtggagcccgacgatgtggattgctggtgtaataccacaagcacatgggtggtgtacggcacctgtcaccacaagaagggagaggcagcaagatccaggagggcagtgacactgccttcccactctaccaggaagctgcagacacgctcccagacctggctggagtccagagagtataccaagcacctgatcagggtggagaactggatctttcgcaatccaggattcgcactggctgccgccgccatcgcatggctgctgggcagctccacctcccagaaagtgatctacctggtcatgatcctgctgatcgcccctgcctatagcatccggtgcatcggcgtgtccaatagagacttcgtggagggcatgtctggcggcacctgggtggatgtggtgctggagcacggcggctgcgtgacagtgatggcccaggacaagccaaccgtggatatcgagctggtgaccacaaccgtgtctaacatggccgaggtgcggagctactgctatgaggccagcatctccgacatggcctctgatagcagatgtcccacccagggcgaggcctacctggacaagcagtctgatacacagtacgtgtgcaagcggaccctggtggacagaggctggggcaatggctgtggcctgtttggcaagggcagcctggtgacatgcgccaagttcgcctgttccaagaagatgaccggcaagtctatccagccagagaacctggagtacaggatcatgctgagcgtgcacggctcccagcactctggcatgatcgtgaacgacacaggccacgagacagatgagaatagggccaaggtggagatcacacctaactctccaagggcagaggccaccctgggaggatttggcagcctgggcctggactgcgagcctaggacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggctcccaggagggagcagtgcacaccgccctggcaggcgccctggaggccgagatggacggagcaaagggccgcctgtctagcggccacctgaagtgcaggctgaagatggataagctgcgcctgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggccggctgatcaccgcaaatccagtgatcacagagtctaccgagaacagcaagatgatgctggagctggaccccccttttggcgatagctatatcgtgatcggcgtgggcgagaagaagatcacacaccactggcacagaagcggctccacaatcggcaaggcctttgaggcaaccgtgcggggagcaaagagaatggccgtgctgggcgacaccgcatgggatttcggcagcgtgggaggcgccctgaactccctgggcaagggcatccaccagatcttcggcgccgcctttaagtccctgttcggcggcatgagctggttctcccagatcctgatcggcacactgctgatgtggctgggcctgaacaccaagaatggctctatcagcctgatgtgcctggctctgggaggggtcctgattttcctgtctaccgccgtgtccgcttga

SEQ ID NO: 344 - DNA, 2091 bp, Artificial Sequence
  Synthetic
atgggaaagaggtctgccgggagtattatgtggctggcttcactggctgtcgtcatcgcctgtgctggagctgctgaggtcactaggcggggctccgcctactatatgtatctagacagaaatgatgccggcgaggccatctcttttcccaccacactgggcatgaacaagtgctacatccagatcatggacctgggccacatgtgcgatgccaccatgagctatgagtgtccaatgctggacgagggcgtggagcccgacgatgtggattgctggtgtaataccacaagcacatgggtggtgtacggcacctgtcaccacaagaagggagagtcaagcagatccaggagggcagtgacactgccttcccactctaccaggaagctgcagacacgctcccagacctggctggagtccagagagtataccaagcacctgatcagggtggagaactggatctttcgcaatccaggattcgcactggctgccgccgccatcgcatggctgctgggcagctccacctcccagaaagtgatctacctggtcatgatcctgctgatcgcccctgcctatagcatccggtgcatcggcgtgtccaatagagacttcgtggagggcatgtctggcggcacctgggtggatgtggtgctggagcacggcggctgcgtgacagtgatggcccaggacaagccaaccgtggatatcgagctggtgaccacaaccgtgtctaacatggccgaggtgcggagctactgctatgaggccagcatctccgacatggcctctgatagcagatgtcccacccagggcgaggcctacctggacaagcagtctgatacacagtacgtgtgcaagcggaccctggtggacagaggctggggcaatggctgtggcctgtttggcaagggcagcctggtgacatgcgccaagttcgcctgttccaagaagatgaccggcaagtctatccagccagagaacctggagtacaggatcatgctgagcgtgcacggctcccagcactctggcatgatcgtgaacgacacaggccacgagacagatgagaatagggccaaggtggagatcacacctaactctccaagggcagaggccaccctgggaggatttggcagcctgggcctggactgcgagcctaggacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggctcccaggagggagcagtgcacaccgccctggcaggcgccctggaggccgagatggacggagcaaagggccgcctgtctagcggccacctgaagtgcaggctgaagatggataagctgcgcctgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggccggctgatcaccgcaaatccagtgatcacagagtctaccgagaacagcaagatgatgctggagctggaccccccttttggcgatagctatatcgtgatcggcgtgggcgagaagaagatcacacaccactggcacagaagcggctccacaatcggcaaggcctttgaggcaaccgtgcggggagcaaagagaatggccgtgctgggcgacaccgcatgggatttcggcagcgtgggaggcgccctgaactccctgggcaagggcatccaccagatcttcggcgccgcctttaagtccctgttcggcggcatgagctggttctcccagatcctgatcggcacactgctgatgtggctgggcctgaacaccaagaatggctctatcagcctgatgtgcctggctctgggaggggtcctgattttcctgtctaccgccgtgtccgcttga

SEQ ID NO: 345 - DNA, 2091 bp, Artificial Sequence
  Synthetic
atgggaaagaggtctgccgggagtattatgtggctggcttcactggctgtcgtcatcgcctgtgctggagctgctgaggtcactaggcggggctccgcctactatatgtatctagacagaaatgatgccggcgaggccatctcttttcccaccacactgggcatgaacaagtgctacatccagatcatggacctgggccacatgtgcgatgccaccatgagctatgagtgtccaatgctggacgagggcgtggagcccgacgatgtggattgctggtgtaataccacaagcacatgggtggtgtacggcacctgtcaccacaagaagggagagtccgcaagatccaggagggcagtgacactgccttcccactctaccaggaagctgcagacacgctcccagacctggctggagtccagagagtataccaagcacctgatcagggtggagaactggatctttcgcaatccaggattcgcactggctgccgccgccatcgcatggctgctgggcagctccacctcccagaaagtgatctacctggtcatgatcctgctgatcgcccctgcctatagcatccggtgcatcggcgtgtccaatagagacttcgtggagggcatgtctggcggcacctgggtggatgtggtgctggagcacggcggctgcgtgacagtgatggcccaggacaagccaaccgtggatatcgagctggtgaccacaaccgtgtctaacatggccgaggtgcggagctactgctatgaggccagcatctccgacatggcctctgatagcagatgtcccacccagggcgaggcctacctggacaagcagtctgatacacagtacgtgtgcaagcggaccctggtggacagaggctggggcaatggctgtggcctgtttggcaagggcagcctggtgacatgcgccaagttcgcctgttccaagaagatgaccggcaagtctatccagccagagaacctggagtacaggatcatgctgagcgtgcacggctcccagcactctggcatgatcgtgaacgacacaggccacgagacagatgagaatagggccaaggtggagatcacacctaactctccaagggcagaggccaccctgggaggatttggcagcctgggcctggactgcgagcctaggacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggctcccaggagggagcagtgcacaccgccctggcaggcgccctggaggccgagatggacggagcaaagggccgcctgtctagcggccacctgaagtgcaggctgaagatggataagctgcgcctgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggccggctgatcaccgcaaatccagtgatcacagagtctaccgagaacagcaagatgatgctggagctggaccccccttttggcgatagctatatcgtgatcggcgtgggcgagaagaagatcacacaccactggcacagaagcggctccacaatcggcaaggcctttgaggcaaccgtgcggggagcaaagagaatggccgtgctgggcgacaccgcatgggatttcggcagcgtgggaggcgccctgaactccctgggcaagggcatccaccagatcttcggcgccgcctttaagtccctgttcggcggcatgagctggttctcccagatcctgatcggcacactgctgatgtggctgggcctgaacaccaagaatggctctatcagcctgatgtgcctggctctgggaggggtcctgattttcctgtctaccgccgtgtccgcttga

SEQ ID NO: 346 - DNA, 2091 bp, Artificial Sequence
  Synthetic
atgggaaagaggtctgccgggagtattatgtggctggcttcactggctgtcgtcatcgcctgtgctggagctgctgaggtcactaggcggggctccgcctactatatgtatctagacagaaatgatgccggcgaggccatctcttttcccaccacactgggcatgaacaagtgctacatccagatcatggacctgggccacatgtgcgatgccaccatgagctatgagtgtccaatgctggacgagggcgtggagcccgacgatgtggattgctggtgtaataccacaagcacatgggtggtgtacggcacctgtcaccacaagaagggagaggcacggagatccaggagggcagtgacactgccttcccactctaccaggaagctgcagacacgctcccagacctggctggagtccagagagtataccaagcacctgatcagggtggagaactggatctttcgcaatccaggattcgcactggctgccgccgccatcgcatggctgctgggcagctccacctcccagaaagtgatctacctggtcatgatcctgctgatcgcccctgcctatagcatccggtgcatcggcgtgtccaatagagacttcgtggagggcatgtctggcggcacctgggtggatgtggtgctggagcacggcggctgcgtgacagtgatggcccaggacaagccaaccgtggatatcgagctggtgaccacaaccgtgtctaacatggccgaggtgcggagctactgctatgaggccagcatctccgacatggcctctgatagcagatgtcccacccagggcgaggcctacctggacaagcagtctgatacacagtacgtgtgcaagcggaccctggtggacagaggcagcggctccggctctggcagcggctccggctctagcctggtgacatgcgccaagttcgcctgttccaagaagatgaccggcaagtctatccagccagagaacctggagtacaggatcatgctgagcgtgcacggctcccagcactctggcatgatcgtgaacgacacaggccacgagacagatgagaatagggccaaggtggagatcacacctaactctccaagggcagaggccaccctgggaggatttggcagcctgggcctggactgcgagcctaggacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggctcccaggagggagcagtgcacaccgccctggcaggcgccctggaggccgagatggacggagcaaagggccgcctgtctagcggccacctgaagtgcaggctgaagatggataagctgcgcctgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggccggctgatcaccgcaaatccagtgatcacagagtctaccgagaacagcaagatgatgctggagctggaccccccttttggcgatagctatatcgtgatcggcgtgggcgagaagaagatcacacaccactggcacagaagcggctccacaatcggcaaggcctttgaggcaaccgtgcggggagcaaagagaatggccgtgctgggcgacaccgcatgggatttcggcagcgtgggaggcgccctgaactccctgggcaagggcatccaccagatcttcggcgccgcctttaagtccctgttcggcggcatgagctggttctcccagatcctgatcggcacactgctgatgtggctgggcctgaacaccaagaatggctctatcagcctgatgtgcctggctctgggaggggtcctgattttcctgtctaccgccgtgtccgcttga

SEQ ID NO: 347 - DNA, 2082 bp, Artificial Sequence
  Synthetic
atgggaaagaggtctgccgggagtattatgtggctggcttcactggctgtcgtcatcgcctgtgctggagctgctgaggtcactaggcggggctccgcctactatatgtatctagacagaaatgatgccggcgaggccatctcttttcccaccacactgggcatgaacaagtgctacatccagatcatggacctgggccacatgtgcgatgccaccatgagctatgagtgtccaatgctggacgagggcgtggagcccgacgatgtggattgctggtgtaataccacaagcacatgggtggtgtacggcacctgtcaccacaagaagggagaggcacggagatccaggagggcagtgacactgccttcccactctaccaggaagctgcagacacgctcccagacctggctggagtccagagagtataccaagcacctgatcagggtggagaactggatctttcgcaatccaggattcgcactggctgccgccgccatcgcatggctgctgggcagctccacctcccagaaagtgatctacctggtcatgatcctgctgatcgcccctgcctatagcatccggtgcatcggcgtgtccaatagagacttcgtggagggcatgtctggcggcacctgggtggatgtggtgctggagcacggcggctgcgtgacagtgatggcccaggacaagccaaccgtggatatcgagctggtgaccacaaccgtgtctaacatggccgaggtgcggagctactgctatgaggccagcatctccgacatggcctctgatagcagatgtcccacccagggcgaggcctacctggacaagcagtctgatacacagtacgtgtgcaagcggaccctggtggacagaggcagcggctccggctctggcagcggcagcctggtgacatgcgccaagttcgcctgttccaagaagatgaccggcaagtctatccagccagagaacctggagtacaggatcatgctgagcgtgcacggctcccagcactctggcatgatcgtgaacgacacaggccacgagacagatgagaatagggccaaggtggagatcacacctaactctccaagggcagaggccaccctgggaggatttggcagcctgggcctggactgcgagcctaggacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggctcccaggagggagcagtgcacaccgccctggcaggcgccctggaggccgagatggacggagcaaagggccgcctgtctagcggccacctgaagtgcaggctgaagatggataagctgcgcctgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggccggctgatcaccgcaaatccagtgatcacagagtctaccgagaacagcaagatgatgctggagctggaccccccttttggcgatagctatatcgtgatcggcgtgggcgagaagaagatcacacaccactggcacagaagcggctccacaatcggcaaggcctttgaggcaaccgtgcggggagcaaagagaatggccgtgctgggcgacaccgcatgggatttcggcagcgtgggaggcgccctgaactccctgggcaagggcatccaccagatcttcggcgccgcctttaagtccctgttcggcggcatgagctggttctcccagatcctgatcggcacactgctgatgtggctgggcctgaacaccaagaatggctctatcagcctgatgtgcctggctctgggaggggtcctgattttcctgtctaccgccgtgtccgcttga

SEQ ID NO: 348 - DNA, 2073 bp, Artificial Sequence
  Synthetic
atgggaaagaggtctgccgggagtattatgtggctggcttcactggctgtcgtcatcgcctgtgctggagctgctgaggtcactaggcggggctccgcctactatatgtatctagacagaaatgatgccggcgaggccatctcttttcccaccacactgggcatgaacaagtgctacatccagatcatggacctgggccacatgtgcgatgccaccatgagctatgagtgtccaatgctggacgagggcgtggagcccgacgatgtggattgctggtgtaataccacaagcacatgggtggtgtacggcacctgtcaccacaagaagggagaggcacggagatccaggagggcagtgacactgccttcccactctaccaggaagctgcagacacgctcccagacctggctggagtccagagagtataccaagcacctgatcagggtggagaactggatctttcgcaatccaggattcgcactggctgccgccgccatcgcatggctgctgggcagctccacctcccagaaagtgatctacctggtcatgatcctgctgatcgcccctgcctatagcatccggtgcatcggcgtgtccaatagagacttcgtggagggcatgtctggcggcacctgggtggatgtggtgctggagcacggcggctgcgtgacagtgatggcccaggacaagccaaccgtggatatcgagctggtgaccacaaccgtgtctaacatggccgaggtgcggagctactgctatgaggccagcatctccgacatggcctctgatagcagatgtcccacccagggcgaggcctacctggacaagcagtctgatacacagtacgtgtgcaagcggaccctggtggacagaggcagcggctccggctctagcctggtgacatgcgccaagttcgcctgttccaagaagatgaccggcaagtctatccagccagagaacctggagtacaggatcatgctgagcgtgcacggctcccagcactctggcatgatcgtgaacgacacaggccacgagacagatgagaatagggccaaggtggagatcacacctaactctccaagggcagaggccaccctgggaggatttggcagcctgggcctggactgcgagcctaggacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggctcccaggagggagcagtgcacaccgccctggcaggcgccctggaggccgagatggacggagcaaagggccgcctgtctagcggccacctgaagtgcaggctgaagatggataagctgcgcctgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggccggctgatcaccgcaaatccagtgatcacagagtctaccgagaacagcaagatgatgctggagctggaccccccttttggcgatagctatatcgtgatcggcgtgggcgagaagaagatcacacaccactggcacagaagcggctccacaatcggcaaggcctttgaggcaaccgtgcggggagcaaagagaatggccgtgctgggcgacaccgcatgggatttcggcagcgtgggaggcgccctgaactccctgggcaagggcatccaccagatcttcggcgccgcctttaagtccctgttcggcggcatgagctggttctcccagatcctgatcggcacactgctgatgtggctgggcctgaacaccaagaatggctctatcagcctgatgtgcctggctctgggaggggtcctgattttcctgtctaccgccgtgtccgcttga

SEQ ID NO: 349 - DNA, 2064 bp, Artificial Sequence
  Synthetic
atgggaaagaggtctgccgggagtattatgtggctggcttcactggctgtcgtcatcgcctgtgctggagctgctgaggtcactaggcggggctccgcctactatatgtatctagacagaaatgatgccggcgaggccatctcttttcccaccacactgggcatgaacaagtgctacatccagatcatggacctgggccacatgtgcgatgccaccatgagctatgagtgtccaatgctggacgagggcgtggagcccgacgatgtggattgctggtgtaataccacaagcacatgggtggtgtacggcacctgtcaccacaagaagggagaggcacggagatccaggagggcagtgacactgccttcccactctaccaggaagctgcagacacgctcccagacctggctggagtccagagagtataccaagcacctgatcagggtggagaactggatctttcgcaatccaggattcgcactggctgccgccgccatcgcatggctgctgggcagctccacctcccagaaagtgatctacctggtcatgatcctgctgatcgcccctgcctatagcatccggtgcatcggcgtgtccaatagagacttcgtggagggcatgtctggcggcacctgggtggatgtggtgctggagcacggcggctgcgtgacagtgatggcccaggacaagccaaccgtggatatcgagctggtgaccacaaccgtgtctaacatggccgaggtgcggagctactgctatgaggccagcatctccgacatggcctctgatagcagatgtcccacccagggcgaggcctacctggacaagcagtctgatacacagtacgtgtgcaagcggaccctggtggacagaggcagcggcagcctggtgacatgcgccaagttcgcctgttccaagaagatgaccggcaagtctatccagccagagaacctggagtacaggatcatgctgagcgtgcacggctcccagcactctggcatgatcgtgaacgacacaggccacgagacagatgagaatagggccaaggtggagatcacacctaactctccaagggcagaggccaccctgggaggatttggcagcctgggcctggactgcgagcctaggacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggctcccaggagggagcagtgcacaccgccctggcaggcgccctggaggccgagatggacggagcaaagggccgcctgtctagcggccacctgaagtgcaggctgaagatggataagctgcgcctgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggccggctgatcaccgcaaatccagtgatcacagagtctaccgagaacagcaagatgatgctggagctggaccccccttttggcgatagctatatcgtgatcggcgtgggcgagaagaagatcacacaccactggcacagaagcggctccacaatcggcaaggcctttgaggcaaccgtgcggggagcaaagagaatggccgtgctgggcgacaccgcatgggatttcggcagcgtgggaggcgccctgaactccctgggcaagggcatccaccagatcttcggcgccgcctttaagtccctgttcggcggcatgagctggttctcccagatcctgatcggcacactgctgatgtggctgggcctgaacaccaagaatggctctatcagcctgatgtgcctggctctgggaggggtcctgattttcctgtctaccgccgtgtccgcttga

SEQ ID NO: 350 - DNA, 2091 bp, Artificial Sequence
  Synthetic
atgggaaagaggtctgccgggagtattatgtggctggcttcactggctgtcgtcatcgcctgtgctggagctgctgaggtcactaggcggggctccgcctactatatgtatctagacagaaatgatgccggcgaggccatctcttttcccaccacactgggcatgaacaagtgctacatccagatcatggacctgggccacatgtgcgatgccaccatgagctatgagtgtccaatgctggacgagggcgtggagcccgacgatgtggattgctggtgtaataccacaagcacatgggtggtgtacggcacctgtcaccacaagaagggagaggcacggagatccaggagggcagtgacactgccttcccactctaccaggaagctgcagacacgctcccagacctggctggagtccagagagtataccaagcacctgatcagggtggagaactggatctttcgcaatccaggattcgcactggctgccgccgccatcgcatggctgctgggcagctccacctcccagaaagtgatctacctggtcatgatcctgctgatcgcccctgcctatagcatccggtgcatcggcgtgtccaatagagacttcgtggagggcatgtctggcggcacctgggtggatgtggtgctggagcacggcggctgcgtgacagtgatggcccaggacaagccaaccgtggatatcgagctggtgaccacaaccgtgtctaacatggccgaggtgcggagctactgctatgaggccagcatctccgacatggcctctgatagcagatgtcccacccagggcgaggcctacctggacaagcagtctgatacacagtacgtgtgcaagcggaccctggtggacagaggctggggcaatggctgtggcctgtttggcaacggcagcctggtgacatgcgccaagttcgcctgttccaagaagatgaccggcaagtctatccagccagagaacctggagtacaggatcatgctgagcgtgcacggctcccagcactctggcatgatcgtgaacgacacaggccacgagacagatgagaatagggccaaggtggagatcacacctaactctccaagggcagaggccaccctgggaggatttggcagcctgggcctggactgcgagcctaggacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggctcccaggagggagcagtgcacaccgccctggcaggcgccctggaggccgagatggacggagcaaagggccgcctgtctagcggccacctgaagtgcaggctgaagatggataagctgcgcctgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggccggctgatcaccgcaaatccagtgatcacagagtctaccgagaacagcaagatgatgctggagctggaccccccttttggcgatagctatatcgtgatcggcgtgggcgagaagaagatcacacaccactggcacagaagcggctccacaatcggcaaggcctttgaggcaaccgtgcggggagcaaagagaatggccgtgctgggcgacaccgcatgggatttcggcagcgtgggaggcgccctgaactccctgggcaagggcatccaccagatcttcggcgccgcctttaagtccctgttcggcggcatgagctggttctcccagatcctgatcggcacactgctgatgtggctgggcctgaacaccaagaatggctctatcagcctgatgtgcctggctctgggaggggtcctgattttcctgtctaccgccgtgtccgcttga

SEQ ID NO: 351 - DNA, 2091 bp, Artificial Sequence
  Synthetic
atgggaaagaggtctgccgggagtattatgtggctggcttcactggctgtcgtcatcgcctgtgctggagctgctgaggtcactaggcggggctccgcctactatatgtatctagacagaaatgatgccggcgaggccatctcttttcccaccacactgggcatgaacaagtgctacatccagatcatggacctgggccacatgtgcgatgccaccatgagctatgagtgtccaatgctggacgagggcgtggagcccgacgatgtggattgctggtgtaataccacaagcacatgggtggtgtacggcacctgtcaccacaagaagggagaggcacggagatccaggagggcagtgacactgccttcccactctaccaggaagctgcagacacgctcccagacctggctggagtccagagagtataccaagcacctgatcagggtggagaactggatctttcgcaatccaggattcgcactggctgccgccgccatcgcatggctgctgggcagctccacctcccagaaagtgatctacctggtcatgatcctgctgatcgcccctgcctatagcatccggtgcatcggcgtgtccaatagagacttcgtggagggcatgtctggcggcacctgggtggatgtggtgctggagcacggcggctgcgtgacagtgatggcccaggacaagccaaccgtggatatcgagctggtgaccacaaccgtgtctaacatggccgaggtgcggagctactgctatgaggccagcatctccgacatggcctctgatagcagatgtcccacccagggcgaggcctacctggacaagcagtctgatacacagtacgtgtgcaagcggaccctggtggacagaggctggggcaatggctgtggcctgtttggcaagggcagcctggtgacatgcgccaagttcgcctgttccaagaagatgaccggcaagtctatccagccagagaacctggagtacaggatcatgctgagcgtgcacggctcccagcactctggcatgatcgtgaacgacacaggccacgagacagatgagaatagggccaaggtggagatcacacctaactctccaagggcagaggccaccctgggaggatttggcagcctgggcctggactgcgagcctaggacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggctcccaggagggagcagtgcacaccgccctggcaggcgccctggaggtggagatggacggagcaaagggccgcctgtctagcggccacctgaagtgcaggctgaagatggataagctgcgcctgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggccggctgatcaccgcaaatccagtgatcacagagtctaccgagaacagcaagatgatgctggagctggaccccccttttggcgatagctatatcgtgatcggcgtgggcgagaagaagatcacacaccactggcacagaagcggctccacaatcggcaaggcctttgaggcaaccgtgcggggagcaaagagaatggccgtgctgggcgacaccgcatgggatttcggcagcgtgggaggcgccctgaactccctgggcaagggcatccaccagatcttcggcgccgcctttaagtccctgttcggcggcatgagctggttctcccagatcctgatcggcacactgctgatgtggctgggcctgaacaccaagaatggctctatcagcctgatgtgcctggctctgggaggggtcctgattttcctgtctaccgccgtgtccgcttga

SEQ ID NO: 352 - DNA, 2091 bp, Artificial Sequence
  Synthetic
atgggaaagaggtctgccgggagtattatgtggctggcttcactggctgtcgtcatcgcctgtgctggagctgctgaggtcactaggcggggctccgcctactatatgtatctagacagaaatgatgccggcgaggccatctcttttcccaccacactgggcatgaacaagtgctacatccagatcatggacctgggccacatgtgcgatgccaccatgagctatgagtgtccaatgctggacgagggcgtggagcccgacgatgtggattgctggtgtaataccacaagcacatgggtggtgtacggcacctgtcaccacaagaagggagaggcacggagatccaggagggcagtgacactgccttcccactctaccaggaagctgcagacacgctcccagacctggctggagtccagagagtataccaagcacctgatcagggtggagaactggatctttcgcaatccaggattcgcactggctgccgccgccatcgcatggctgctgggcagctccacctcccagaaagtgatctacctggtcatgatcctgctgatcgcccctgcctatagcatccggtgcatcggcgtgtccaatagagacttcgtggagggcatgtctggcggcacctgggtggatgtggtgctggagcacggcggctgcgtgacagtgatggcccaggacaagccaaccgtggatatcgagctggtgaccacaaccgtgtctaacatggccgaggtgcggagctactgctatgaggccagcatctccgacatggcctctgatagcagatgtcccacccagggcgaggcctacctggacaagcagtctgatacacagtacgtgtgcaagcggaccctggtggacagaggctggggcaatggctgtggcctgtttggcaagggcagcctggtgacatgcgccaagttcgcctgttccaagaagatgaccggcaagtctatccagccagagaacctggagtacaggatcatgctgagcgtgcacggctcccagcactctggcatgatcgtgaacgacacaggccacgagacagatgagaatagggccaaggtggagatcacacctaactctccaagggcagaggccaccctgggaggatttggcagcctgggcctggactgcgagcctaggacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggctcccaggagggagcagtgcacaccgccctggcaggcgccctggaggccgagatggacggagcaaagggccgcctgtctagcggccacctgaagtgcaggctgaagatggataagctgcagctgaagggcacaacctacggcgtgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggccggctgatcaccgcaaatccagtgatcacagagtctaccgagaacagcaagatgatgctggagctggaccccccttttggcgatagctatatcgtgatcggcgtgggcgagaagaagatcacacaccactggcacagaagcggctccacaatcggcaaggcctttgaggcaaccgtgcggggagcaaagagaatggccgtgctgggcgacaccgcatgggatttcggcagcgtgggaggcgccctgaactccctgggcaagggcatccaccagatcttcggcgccgcctttaagtccctgttcggcggcatgagctggttctcccagatcctgatcggcacactgctgatgtggctgggcctgaacaccaagaatggctctatcagcctgatgtgcctggctctgggaggggtcctgattttcctgtctaccgccgtgtccgcttga

SEQ ID NO: 353 - DNA, 2091 bp, Artificial Sequence
  Synthetic
atgggaaagaggtctgccgggagtattatgtggctggcttcactggctgtcgtcatcgcctgtgctggagctgctgaggtcactaggcggggctccgcctactatatgtatctagacagaaatgatgccggcgaggccatctcttttcccaccacactgggcatgaacaagtgctacatccagatcatggacctgggccacatgtgcgatgccaccatgagctatgagtgtccaatgctggacgagggcgtggagcccgacgatgtggattgctggtgtaataccacaagcacatgggtggtgtacggcacctgtcaccacaagaagggagaggcacggagatccaggagggcagtgacactgccttcccactctaccaggaagctgcagacacgctcccagacctggctggagtccagagagtataccaagcacctgatcagggtggagaactggatctttcgcaatccaggattcgcactggctgccgccgccatcgcatggctgctgggcagctccacctcccagaaagtgatctacctggtcatgatcctgctgatcgcccctgcctatagcatccggtgcatcggcgtgtccaatagagacttcgtggagggcatgtctggcggcacctgggtggatgtggtgctggagcacggcggctgcgtgacagtgatggcccaggacaagccaaccgtggatatcgagctggtgaccacaaccgtgtctaacatggccgaggtgcggagctactgctatgaggccagcatctccgacatggcctctgatagcagatgtcccacccagggcgaggcctacctggacaagcagtctgatacacagtacgtgtgcaagcggaccctggtggacagaggctggggcaatggctgtggcctgtttggcaagggcagcctggtgacatgcgccaagttcgcctgttccaagaagatgaccggcaagtctatccagccagagaacctggagtacaggatcatgctgagcgtgcacggctcccagcactctggcatgatcgtgaacgacacaggccacgagacagatgagaatagggccaaggtggagatcacacctaactctccaagggcagaggccaccctgggaggatttggcagcctgggcctggactgcgagcctaggacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggctcccaggagggagcagtgcacaccgccctggcaggcgccctggaggccgagatggacggagcaaagggccgcctgtctagcggccacctgaagtgcaggctgaagatggataagctgcgcctgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggccggctgatcaccgcaaatccagtgatcacagagtctaccgagaacagcaagatgatgctggagctggaccccccttttggcgatagctatatcgtgatcggcgtgggcgagaagaagatcacacaccactggcacagaagcggctccacaatcggcaaggccttcacaaccacactgaaaggagcacagagactggccgccctgggcgacaccgcatgggattttggctccgtgggaggcgtgttcacatctgtgggcaaggcagtgcaccaggtgttcggcgccgcctttaagtccctgttcggcggcatgagctggttctcccagatcctgatcggcacactgctgatgtggctgggcctgaacaccaagaatggctctatcagcctgatgtgcctggctctgggaggggtcctgattttcctgtctaccgccgtgtccgcttga

SEQ ID NO: 354 - DNA, 2091 bp, Artificial Sequence
  Synthetic
atgggaaagaggtctgccgggagtattatgtggctggcttcactggctgtcgtcatcgcctgtgctggagctgctgaggtcactaggcggggctccgcctactatatgtatctagacagaaatgatgccggcgaggccatctcttttcccaccacactgggcatgaacaagtgctacatccagatcatggacctgggccacatgtgcgatgccaccatgagctatgagtgtccaatgctggacgagggcgtggagcccgacgatgtggattgctggtgtaataccacaagcacatgggtggtgtacggcacctgtcaccacaagaagggagaggcacggagatccaggagggcagtgacactgccttcccactctaccaggaagctgcagacacgctcccagacctggctggagtccagagagtataccaagcacctgatcagggtggagaactggatctttcgcaatccaggattcgcactggctgccgccgccatcgcatggctgctgggcagctccacctcccagaaagtgatctacctggtcatgatcctgctgatcgcccctgcctatagcatccggtgcatcggcgtgtccaatagagacttcgtggagggcatgtctggcggcacctgggtggatgtggtgctggagcacggcggctgcgtgacagtgatggcccaggacaagccaaccgtggatatcgagctggtgaccacaaccgtgtctaacatggccgaggtgcggagctactgctatgaggccagcatctccgacatggcctctgatagcagatgtcccacccagggcgaggcctacctggacaagcagtctgatacacagtacgtgtgcaagcggaccctggtggacagaggctggggcaatggctgtggcctgtttggcaagggcagcctggtgacatgcgccaagttcgcctgttccaagaagatgaccggcaagtctatccagccagagaacctggagtacaggatcatgctgagcgtgcacggctcccagcactctggcatgatcgtgaacgacacaggccacgagacagatgagaatagggccaaggtggagatcacacctaactctccaagggcagaggccaccctgggaggatttggcagcctgggcctggactgcgagcctaggacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggctcccaggagggagcagtgcacaccgccctggcaggcgccctggaggccgagatggacggagcaaagggccgcctgtctagcggccacctgaagtgcaggctgaagatggataagctgcgcctgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggccggctgatcaccgcaaatccagtgatcacagagtctaccgagaacagcaagatgatgctggagctggaccccccttttggcgatagctatatcgtgatcggcgtgggcgagaagaagatcacacaccactggcacagaagcggctcctccatcggcaaggccttcacaaccacactgaaaggagcacagagactggccgccctgggcgacaccgcatgggattttggctccgtgggaggcgtgttcacatctgtgggcaaggcagtgcaccaggtgttcggaggcgcctttagatctctgttcggcggcatgagctggatcacccagggcctgctgggcgccctgctgctgtggatgggcatcaacgcccgggacagatccatcgccctgacttttctggctgtcggcggagtgctgctgttcctgagcgtgaatgtccatgcctga

SEQ ID NO: 355 - DNA, 2091 bp, Artificial Sequence
  Synthetic
atgggaaagaggtctgccgggagtattatgtggctggcttcactggctgtcgtcatcgcctgtgctggagctgctgaggtcactaggcggggctccgcctactatatgtatctagacagaaatgatgccggcgaggccatctcttttcccaccacactgggcatgaacaagtgctacatccagatcatggacctgggccacatgtgcgatgccaccatgagctatgagtgtccaatgctggacgagggcgtggagcccgacgatgtggattgctggtgtaataccacaagcacatgggtggtgtacggcacctgtcaccacaagaagggagaggcacggagatccaggagggcagtgacactgccttcccactctaccaggaagctgcagacacgctcccagacctggctggagtccagagagtataccaagcacctgatcagggtggagaactggatctttcgcaatccaggattcgcactggctgccgccgccatcgcatggctgctgggcagctccacctcccagaaagtgatctacctggtcatgatcctgctgatcgcccctgcctatagcatccggtgcatcggcgtgtccaatagagacttcgtggagggcatgtctggcggcacctgggtggatgtggtgctggagcacggcggctgcgtgacagtgatggcccaggacaagccaaccgtggatatcgagctggtgaccacaaccgtgtctaacatggccgaggtgcggagctactgctatgaggccagcatctccgacatggcctctgatagcagatgtcccacccagggcgaggcctacctggacaagcagtctgatacacagtacgtgtgcaagcggaccctggtggacagaggctggggcaatggctgtggcctgtttggcaagggcagcctggtgacatgcgccaagttcgcctgttccaagaagatgaccggcaagtctatccagccagagaacctggagtacaggatcatgctgagcgtgcacggctcccagcactctggcatgatcgtgaacgacacaggccacgagacagatgagaatagggccaaggtggagatcacacctaactctccaagggcagaggccaccctgggaggatttggcagcctgggcctggactgcgagcctaggacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggctcccaggagggagcagtgcacaccgccctggcaggcgccctggaggccgagatggacggagcaaagggccgcctgtctagcggccacctgaagtgcaggctgaagatggataagctgcgcctgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggccggctgatcaccgcaaatccagtgatcacagagtctaccgagaacagcaagatgatgctggagctggaccccccttttggcgatagctatatcgtgatcggcgtgggcgagaagaagatcacacaccactggcacagaagcggctccaccctgggcaaggccttctctacaaccctgaagggagcacagagactggccgccctgggcgacaccgcctgggattttggctccatcggcggcgtgttcaactctatcggaagggcagtgcaccaggtgttcggaggcgcctttagaacactgttcggcggcatgagctggatcacccagggcctgatgggcgccctgctgctgtggatgggcgtgaatgccagggaccgctccatcgccctggcctttctggcaacaggaggcgtgctggtgttcctggccaccaacgtgcacgcctga

SEQ ID NO: 356 - DNA, 2091 bp, Artificial Sequence
  Synthetic
atgggaaagaggtctgccgggagtattatgtggctggcttcactggctgtcgtcatcgcctgtgctggagctgctgaggtcactaggcggggctccgcctactatatgtatctagacagaaatgatgccggcgaggccatctcttttcccaccacactgggcatgaacaagtgctacatccagatcatggacctgggccacatgtgcgatgccaccatgagctatgagtgtccaatgctggacgagggcgtggagcccgacgatgtggattgctggtgtaataccacaagcacatgggtggtgtacggcacctgtcaccacaagaagggagaggcacggagatccaggagggcagtgacactgccttcccactctaccaggaagctgcagacacgctcccagacctggctggagtccagagagtataccaagcacctgatcagggtggagaactggatctttcgcaatccaggattcgcactggctgccgccgccatcgcatggctgctgggcagctccacctcccagaaagtgatctacctggtcatgatcctgctgatcgcccctgcctatagcatccggtgcatcggcgtgtccaatagagacttcgtggagggcatgtctggcggcacctgggtggatgtggtgctggagcacggcggctgcgtgacagtgatggcccaggacaagccaaccgtggatatcgagctggtgaccacaaccgtgtctaacatggccgaggtgcggagctactgctatgaggccagcatctccgacatggcctctgatagcagatgtcccacccagggcgaggcctacctggacaagcagtctgatacacagtacgtgtgcaagcggaccctggtggacagaggctggggcaatggctgtggcctgtttggcaagggcagcctggtgacatgcgccaagttcgcctgttccaagaagatgaccggcaagtctatccagccagagaacctggagtacaggatcatgctgagcgtgcacggctcccagcactctggcatgatcgtgaacgacacaggccacgagacagatgagaatagggccaaggtggagatcacacctaactctccaagggcagaggccaccctgggaggatttggcagcctgggcctggactgcgagcctaggacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggctcccaggagggagcagtgcacaccgccctggcaggcgccctggaggccgagatggacggagcaaagggccgcctgtctagcggccacctgaagtgcaggctgaagatggataagctgcgcctgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggccggctgatcaccgcaaatccagtgatcacagagtctaccgagaacagcaagatgatgctggagctggaccccccttttggcgatagctatatcgtgatcggcgtgggcgagaagaagatcacacaccactggcacagaagcggctcctccatcggcaaggccttcacaaccacactgaaaggagcacagagactggccgccctgggcgacaccgcatgggattttggctccgtgggaggcgtgttcacatctgtgggcaaggcagtgcaccaggtgttcggaggcgcctttagatccctgttcggcggcatgagctggttctcccagatcctgatcggcacactgctgatgtggctgggcctgaacaccaagaatggctctatcagcctgatgtgcctggctctgggaggggtcctgattttcctgtctaccgccgtgtccgcttga

SEQ ID NO: 357 - DNA, 2091 bp, Artificial Sequence
  Synthetic
atgggaaagaggtctgccgggagtattatgtggctggcttcactggctgtcgtcatcgcctgtgctggagctgctgaggtcactaggcggggctccgcctactatatgtatctagacagaaatgatgccggcgaggccatctcttttcccaccacactgggcatgaacaagtgctacatccagatcatggacctgggccacatgtgcgatgccaccatgagctatgagtgtccaatgctggacgagggcgtggagcccgacgatgtggattgctggtgtaataccacaagcacatgggtggtgtacggcacctgtcaccacaagaagggagaggcacggagatccaggagggcagtgacactgccttcccactctaccaggaagctgcagacacgctcccagacctggctggagtccagagagtataccaagcacctgatcagggtggagaactggatctttcgcaatccaggattcgcactggctgccgccgccatcgcatggctgctgggcagctccacctcccagaaagtgatctacctggtcatgatcctgctgatcgcccctgcctatagcatccggtgcatcggcgtgtccaatagagacttcgtggagggcatgtctggcggcacctgggtggatgtggtgctggagcacggcggctgcgtgacagtgatggcccaggacaagccaaccgtggatatcgagctggtgaccacaaccgtgtctaacatggccgaggtgcggagctactgctatgaggccagcatctccgacatggcctctgatagcagatgtcccacccagggcgaggcctacctggacaagcagtctgatacacagtacgtgtgcaagcggaccctggtggacagaggctggggcaatggctgtggcctgtttggcaagggcagcctggtgacatgcgccaagttcgcctgttccaagaagatgaccggcaagtctatccagccagagaacctggagtacaggatcatgctgagcgtgcacggctcccagcactctggcatgatcgtgaacgacacaggccacgagacagatgagaatagggccaaggtggagatcacacctaactctccaagggcagaggccaccctgggaggatttggcagcctgggcctggactgcgagcctaggacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggctcccaggagggagcagtgcacaccgccctggcaggcgccctggaggccgagatggacggagcaaagggccgcctgtctagcggccacctgaagtgcaggctgaagatggataagctgcgcctgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggccggctgatcaccgcaaatccagtgatcacagagtctaccgagaacagcaagatgatgctggagctggaccccccttttggcgatagctatatcgtgatcggcgtgggcgagaagaagatcacacaccactggcacagaagcggctccaccctgggcaaggccttctctacaaccctgaagggagcacagagactggccgccctgggcgacaccgcctgggattttggctccatcggcggcgtgttcaactctatcggaagggcagtgcaccaggtgttcggaggcgcctttagaacactgttcggcggcatgagctggttctcccagatcctgatcggcacactgctgatgtggctgggcctgaacaccaagaatggctctatcagcctgatgtgcctggctctgggaggggtcctgattttcctgtctaccgccgtgtccgcttga

SEQ ID NO: 358 - DNA, 2091 bp, Artificial Sequence
  Synthetic
atgggaaagaggtctgccgggagtattatgtggctggcttcactggctgtcgtcatcgcctgtgctggagctgctgaggtcactaggcggggctccgcctactatatgtatctagacagaaatgatgccggcgaggccatctcttttcccaccacactgggcatgaacaagtgctacatccagatcatggacctgggccacatgtgcgatgccaccatgagctatgagtgtccaatgctggacgagggcgtggagcccgacgatgtggattgctggtgtaataccacaagcacatgggtggtgtacggcacctgtcaccacaagaagggagaggcacggagatccaggagggcagtgacactgccttcccactctaccaggaagctgcagacacgctcccagacctggctggagtccagagagtataccaagcacctgatcagggtggagaactggatctttcgcaatccaggattcgcactggctgccgccgccatcgcatggctgctgggcagctccacctcccagaaagtgatctacctggtcatgatcctgctgatcgcccctgcctatagcatccggtgcatcggcgtgtccaatagagacttcgtggagggcatgtctggcggcacctgggtggatgtggtgctggagcacggcggctgcgtgacagtgatggcccaggacaagccaaccgtggatatcgagctggtgaccacaaccgtgtctaacatggccgaggtgcggagctactgctatgaggccagcatctccgacatggcctctgatagcagatgtcccacccagggcgaggcctacctggacaagcagtctgatacacagtacgtgtgcaagcggaccctggtggacagaggctggggcaatggctgtggcctgtttggcaagggcagcctggtgacatgcgccaagttcgcctgttccaagaagatgaccggcaagtctatccagccagagaacctggagtacaggatcatgctgagcgtgcacggctcccagcactctggcatgatcgtgaacgacacaggccacgagacagatgagaatagggccaaggtggagatcacacctaactctccaagggcagaggccaccctgggaggatttggcagcctgggcctggactgcgagcctaggacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggctcccaggagggagcagtgcacaccgccctggcaggcgccctggaggccgagatggacggagcaaagggccgcctgtctagcggccacctgaagtgcaggctgaagatggataagctgcgcctgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggccggctgatcaccgcaaatccagtgatcacagagtctaccgagaacagcaagatgatgctggagctggaccccccttttggcgatagctatatcgtgatcggcgtgggcgagaagaagatcacacaccactggcacagaagcggctcctccatcggcaaggccttcacaaccacactgaaaggagcacagagactggccgccctgggcgacaccgcatgggattttggctccgtgggaggcgtgttcacatctgtgggcaaggcagtgcaccagatcttcggcgccgcctttaagtccctgttcggcggcatgagctggttctcccagatcctgatcggcacactgctgatgtggctgggcctgaacaccaagaatggctctatcagcctgatgtgcctggctctgggaggggtcctgattttcctgtctaccgccgtgtccgcttga

SEQ ID NO: 359 - DNA, 2091 bp, Artificial Sequence
  Synthetic
atgggaaagaggtctgccgggagtattatgtggctggcttcactggctgtcgtcatcgcctgtgctggagctgctgaggtcactaggcggggctccgcctactatatgtatctagacagaaatgatgccggcgaggccatctcttttcccaccacactgggcatgaacaagtgctacatccagatcatggacctgggccacatgtgcgatgccaccatgagctatgagtgtccaatgctggacgagggcgtggagcccgacgatgtggattgctggtgtaataccacaagcacatgggtggtgtacggcacctgtcaccacaagaagggagaggcacggagatccaggagggcagtgacactgccttcccactctaccaggaagctgcagacacgctcccagacctggctggagtccagagagtataccaagcacctgatcagggtggagaactggatctttcgcaatccaggattcgcactggctgccgccgccatcgcatggctgctgggcagctccacctcccagaaagtgatctacctggtcatgatcctgctgatcgcccctgcctatagcatccggtgcatcggcgtgtccaatagagacttcgtggagggcatgtctggcggcacctgggtggatgtggtgctggagcacggcggctgcgtgacagtgatggcccaggacaagccaaccgtggatatcgagctggtgaccacaaccgtgtctaacatggccgaggtgcggagctactgctatgaggccagcatctccgacatggcctctgatagcagatgtcccacccagggcgaggcctacctggacaagcagtctgatacacagtacgtgtgcaagcggaccctggtggacagaggctggggcaatggctgtggcctgtttggcaagggcagcctggtgacatgcgccaagttcgcctgttccaagaagatgaccggcaagtctatccagccagagaacctggagtacaggatcatgctgagcgtgcacggctcccagcactctggcatgatcgtgaacgacacaggccacgagacagatgagaatagggccaaggtggagatcacacctaactctccaagggcagaggccaccctgggaggatttggcagcctgggcctggactgcgagcctaggacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggctcccaggagggagcagtgcacaccgccctggcaggcgccctggaggccgagatggacggagcaaagggccgcctgtctagcggccacctgaagtgcaggctgaagatggataagctgcgcctgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggccggctgatcaccgcaaatccagtgatcacagagtctaccgagaacagcaagatgatgctggagctggaccccccttttggcgatagctatatcgtgatcggcgtgggcgagaagaagatcacacaccactggcacagaagcggctccaccctgggcaaggccttctctacaaccctgaagggagcacagagactggccgccctgggcgacaccgcctgggattttggctccatcggcggcgtgttcaactctatcggaagggcagtgcaccagatcttcggcgccgcctttaagtccctgttcggcggcatgagctggttctcccagatcctgatcggcacactgctgatgtggctgggcctgaacaccaagaatggctctatcagcctgatgtgcctggctctgggaggggtcctgattttcctgtctaccgccgtgtccgcttga

SEQ ID NO: 360 - DNA, 2091 bp, Artificial Sequence
  Synthetic
atgggaaagaggtctgccgggagtattatgtggctggcttcactggctgtcgtcatcgcctgtgctggagctgctgaggtcactaggcggggctccgcctactatatgtatctagacagaaatgatgccggcgaggccatctcttttcccaccacactgggcatgaacaagtgctacatccagatcatggacctgggccacatgtgcgatgccaccatgagctatgagtgtccaatgctggacgagggcgtggagcccgacgatgtggattgctggtgtaataccacaagcacatgggtggtgtacggcacctgtcaccacaagaagggagaggcacggagatccaggagggcagtgacactgccttcccactctaccaggaagctgcagacacgctcccagacctggctggagtccagagagtataccaagcacctgatcagggtggagaactggatctttcgcaatccaggattcgcactggctgccgccgccatcgcatggctgctgggcagctccacctcccagaaagtgatctacctggtcatgatcctgctgatcgcccctgcctatagcatccggtgcatcggcgtgtccaatagagacttcgtggagggcatgtctggcggcacctgggtggatgtggtgctggagcacggcggctgcgtgacagtgatggcccaggacaagccaaccgtggatatcgagctggtgaccacaaccgtgtctaacatggccgaggtgcggagctactgctatgaggccagcatctccgacatggcctctgatagcagatgtcccacccagggcgaggcctacctggacaagcagtctgatacacagtacgtgtgcaagcggaccctggtggacagaggctggggcaatggctgtggcctgtttggcaagggcagcctggtgacatgcgccaagttcgcctgttccaagaagatgaccggcaagtctatccagccagagaacctggagtacaggatcatgctgagcgtgcacggctcccagcactctggcatgatcgtgaacgacacaggccacgagacagatgagaatagggccaaggtggagatcacacctaactctccaagggcagaggccaccctgggaggatttggcagcctgggcctggactgcgagcctaggacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggctcccaggagggagcagtgcacaccgccctggcaggcgccctggaggccgagatggacggagcaaagggccgcctgtctagcggccacctgaagtgcaggctgaagatggataagctgcgcctgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggccggctgatcaccgcaaatccagtgatcacagagtctaccgagaacagcaagatgatgctggagctggaccccccttttggcgatagctatatcgtgatcggcgtgggcgagaagaagatcacacaccactggcacagaagcggctccacactgggcaaggcctttgaggcaaccgtgcggggagcaaagagactggccgtgctgggcgacaccgcatgggatttcggcagcgtgggaggcgccctgaactccctgggcaagggcatccaccagatcttcggcgccgcctttaagtccctgttcggcggcatgagctggttctcccagatcctgatcggcacactgctgatgtggctgggcctgaacaccaagaatggctctatcagcctgatgtgcctggctctgggaggggtcctgattttcctgtctaccgccgtgtccgcttga

SEQ ID NO: 361 - DNA, 2091 bp, Artificial Sequence
  Synthetic
atgggaaagaggtctgccgggagtattatgtggctggcttcactggctgtcgtcatcgcctgtgctggagctgctgaggtcactaggcggggctccgcctactatatgtatctagacagaaatgatgccggcgaggccatctcttttcccaccacactgggcatgaacaagtgctacatccagatcatggacctgggccacatgtgcgatgccaccatgagctatgagtgtccaatgctggacgagggcgtggagcccgacgatgtggattgctggtgtaataccacaagcacatgggtggtgtacggcacctgtcaccacaagaagggagaggcacggagatccaggagggcagtgacactgccttcccactctaccaggaagctgcagacacgctcccagacctggctggagtccagagagtataccaagcacctgatcagggtggagaactggatctttcgcaatccaggattcgcactggctgccgccgccatcgcatggctgctgggcagctccacctcccagaaagtgatctacctggtcatgatcctgctgatcgcccctgcctatagcatccggtgcatcggcgtgtccaatagagacttcgtggagggcatgtctggcggcacctgggtggatgtggtgctggagcacggcggctgcgtgacagtgatggcccaggacaagccaaccgtggatatcgagctggtgaccacaaccgtgtctaacatggccgaggtgcggagctactgctatgaggccaacatctccgacatggcctctgatagcagatgtcccacccagggcgaggcctacctggacaagcagtctgatacacagtacgtgtgcaagcggaccctggtggacagaggctggggcaatggctgtggcctgtttggcaagggcagcctggtgacatgcgccaagttcgcctgttccaagaagatgaccggcaagtctatccagccagagaacctggagtacaggatcatgctgagcgtgcacggctcccagcactctggcatgatcgtgaacgacacaggccacgagacagatgagaatagggccaaggtggagatcacacctaactctccaagggcagaggccaccctgggaggatttggcagcctgggcctggactgcgagcctaggacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggctcccaggagggagcagtgcacaccgccctggcaggcgccctggaggccgagatggacggagcaaagggccgcctgtctagcggccacctgaagtgcaggctgaagatggataagctgcgcctgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggccggctgatcaccgcaaatccagtgatcacagagtctaccgagaacagcaagatgatgctggagctggaccccccttttggcgatagctatatcgtgatcggcgtgggcgagaagaagatcacacaccactggcacagaagcggctccacaatcggcaaggcctttgaggcaaccgtgcggggagcaaagagaatggccgtgctgggcgacaccgcatgggatttcggcagcgtgggaggcgccctgaactccctgggcaagggcatccaccagatcttcggcgccgcctttaagtccctgttcggcggcatgagctggttctcccagatcctgatcggcacactgctgatgtggctgggcctgaacaccaagaatggctctatcagcctgatgtgcctggctctgggaggggtcctgattttcctgtctaccgccgtgtccgcttga

SEQ ID NO: 362 - DNA, 2091 bp, Artificial Sequence
  Synthetic
atgggaaagaggtctgccgggagtattatgtggctggcttcactggctgtcgtcatcgcctgtgctggagctgctgaggtcactaggcggggctccgcctactatatgtatctagacagaaatgatgccggcgaggccatctcttttcccaccacactgggcatgaacaagtgctacatccagatcatggacctgggccacatgtgcgatgccaccatgagctatgagtgtccaatgctggacgagggcgtggagcccgacgatgtggattgctggtgtaataccacaagcacatgggtggtgtacggcacctgtcaccacaagaagggagaggcacggagatccaggagggcagtgacactgccttcccactctaccaggaagctgcagacacgctcccagacctggctggagtccagagagtataccaagcacctgatcagggtggagaactggatctttcgcaatccaggattcgcactggctgccgccgccatcgcatggctgctgggcagctccacctcccagaaagtgatctacctggtcatgatcctgctgatcgcccctgcctatagcatccggtgcatcggcgtgtccaatagagacttcgtggagggcatgtctggcggcacctgggtggatgtggtgctggagcacggcggctgcgtgacagtgatggcccaggacaagccaaccgtggatatcgagctggtgaccacaaccgtgtctaacatggccgaggtgcggagctactgctatgaggccagcatctccgacaacgcctctgatagcagatgtcccacccagggcgaggcctacctggacaagcagtctgatacacagtacgtgtgcaagcggaccctggtggacagaggctggggcaatggctgtggcctgtttggcaagggcagcctggtgacatgcgccaagttcgcctgttccaagaagatgaccggcaagtctatccagccagagaacctggagtacaggatcatgctgagcgtgcacggctcccagcactctggcatgatcgtgaacgacacaggccacgagacagatgagaatagggccaaggtggagatcacacctaactctccaagggcagaggccaccctgggaggatttggcagcctgggcctggactgcgagcctaggacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggctcccaggagggagcagtgcacaccgccctggcaggcgccctggaggccgagatggacggagcaaagggccgcctgtctagcggccacctgaagtgcaggctgaagatggataagctgcgcctgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggccggctgatcaccgcaaatccagtgatcacagagtctaccgagaacagcaagatgatgctggagctggaccccccttttggcgatagctatatcgtgatcggcgtgggcgagaagaagatcacacaccactggcacagaagcggctccacaatcggcaaggcctttgaggcaaccgtgcggggagcaaagagaatggccgtgctgggcgacaccgcatgggatttcggcagcgtgggaggcgccctgaactccctgggcaagggcatccaccagatcttcggcgccgcctttaagtccctgttcggcggcatgagctggttctcccagatcctgatcggcacactgctgatgtggctgggcctgaacaccaagaatggctctatcagcctgatgtgcctggctctgggaggggtcctgattttcctgtctaccgccgtgtccgcttga

SEQ ID NO: 363 - DNA, 2091 bp, Artificial Sequence
  Synthetic
atgggaaagaggtctgccgggagtattatgtggctggcttcactggctgtcgtcatcgcctgtgctggagctgctgaggtcactaggcggggctccgcctactatatgtatctagacagaaatgatgccggcgaggtgatctcttttcccaccacactgggcatgaacaagtgctacatccagatcatggacctgggccacatgtgcgatgccaccatgagctatgagtgtccaatgctggacgagggcgtggagcccgacgatgtggattgctggtgtaatacctccagcacatgggtggtgtacggcacctgtcaccacaagaagggagaggcacggagagcaaggagggcagtgacactgccttcccactctaccaggaagctgcagacacgctcccagacctggctggagtccagagagtataccaagcacctgatcagggtggagaactggatctttcgcaatccaggattcgcactggctgccgccgccatcgcatggctgctgggcagctccacctcccagaaagtgatctacctggtcatgatcctgctgatcgcccctgcctatagcatccggtgcatcggcgtgtccaatagagacttcgtggagggcatgtctggcggcacctgggtggatgtggtgctggagcacggcggctgcgtgacagtgatggcccaggacaagccaaccgtggatatcgagctggtgaccacaaccgtgtctaacatggccgaggtgcggagctactgctatgaggccagcatctccgacaacgcctctgatagcagatgtcccacccagggcgaggcctacctggacaagcagtctgatacacagtacgtgtgcaagcggaccctggtggacagaggcagcggctccggctctggcagcggctccggctctagcctggtgacatgcgccaagttcgcctgttccaagaagatgaccggcaagtctatccagccagagaacctggagtacaggatcatgctgagcgtgcacggctcccagcactctggcatgatcgtgaacgacacaggccacgagacagatgagaatagggccaaggtggagatcacacctaactctccaagggcagaggccaccctgggaggatttggcagcctgggcctggactgcgagcctaggacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggctcccaggagggagcagtgcacaccgccctggcaggcgccctggaggtggagatggacggagcaaagggccggctgtctagcggccacctgaagtgcagactgaagatggataagctgcagctgaagggcacaacctacggcgtgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggccggctgatcaccgcaaatccagtgatcacagagtctaccgagaacagcaagatgatgctggagctggaccccccttttggcgatagctatatcgtgatcggcgtgggcgagaagaagatcacacaccactggcacagaagcggctccaccctgggcaaggccttctctacaaccctgaagggagcacagagactggccgccctgggcgacaccgcctgggattttggctccatcggcggcgtgttcaactctatcggaagggcagtgcaccaggtgttcggaggcgcctttagaacactgttcggcggcatgagctggatcacccagggcctgatgggcgccctgctgctgtggatgggcgtgaatgccagggaccgctccatcgccctggcctttctggcaacaggaggcgtgctggtgttcctggccaccaacgtgcacgcctga

SEQ ID NO: 364 - DNA, 2091 bp, Artificial Sequence
  Synthetic
atgggaaagaggtctgccgggagtattatgtggctggcttcactggctgtcgtcatcgcctgtgctggagctgctgaggtcactaggcggggctccgcctactatatgtatctagacagaaatgatgccggcgaggtgatctcttttcccaccacactgggcatgaacaagtgctacatccagatcatggacctgggccacatgtgcgatgccaccatgagctatgagtgtccaatgctggacgagggcgtggagcccgacgatgtggattgctggtgtaatacctccagcacatgggtggtgtacggcacctgtcaccacaagaagggagagtcaagcagatccaggagggcagtgacactgccttcccactctaccaggaagctgcagacacgctcccagacctggctggagtccagagagtataccaagcacctgatcagggtggagaactggatctttcgcaatccaggattcgcactggctgccgccgccatcgcatggctgctgggcagctccacctcccagaaagtgatctacctggtcatgatcctgctgatcgcccctgcctatagcatccggtgcatcggcgtgtccaatagagacttcgtggagggcatgtctggcggcacctgggtggatgtggtgctggagcacggcggctgcgtgacagtgatggcccaggacaagccaaccgtggatatcgagctggtgaccacaaccgtgtctaacatggccgaggtgcggagctactgctatgaggccagcatctccgacaacgcctctgatagcagatgtcccacccagggcgaggcctacctggacaagcagtctgatacacagtacgtgtgcaagcggaccctggtggacagaggcagcggctccggctctggcagcggctccggctctagcctggtgacatgcgccaagttcgcctgttccaagaagatgaccggcaagtctatccagccagagaacctggagtacaggatcatgctgagcgtgcacggctcccagcactctggcatgatcgtgaacgacacaggccacgagacagatgagaatagggccaaggtggagatcacacctaactctccaagggcagaggccaccctgggaggatttggcagcctgggcctggactgcgagcctaggacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggctcccaggagggagcagtgcacaccgccctggcaggcgccctggaggtggagatggacggagcaaagggccggctgtctagcggccacctgaagtgcagactgaagatggataagctgcagctgaagggcacaacctacggcgtgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggccggctgatcaccgcaaatccagtgatcacagagtctaccgagaacagcaagatgatgctggagctggaccccccttttggcgatagctatatcgtgatcggcgtgggcgagaagaagatcacacaccactggcacagaagcggctccaccctgggcaaggccttctctacaaccctgaagggagcacagagactggccgccctgggcgacaccgcctgggattttggctccatcggcggcgtgttcaactctatcggaagggcagtgcaccaggtgttcggaggcgcctttagaacactgttcggcggcatgagctggatcacccagggcctgatgggcgccctgctgctgtggatgggcgtgaatgccagggaccgctccatcgccctggcctttctggcaacaggaggcgtgctggtgttcctggccaccaacgtgcacgcctga

SEQ ID NO: 365 - DNA, 2064 bp, Artificial Sequence
  Synthetic
atgggaaagaggtctgccgggagtattatgtggctggcttcactggctgtcgtcatcgcctgtgctggagctgctgaggtcactaggcggggctccgcctactatatgtatctagacagaaatgatgccggcgaggtgatctcttttcccaccacactgggcatgaacaagtgctacatccagatcatggacctgggccacatgtgcgatgccaccatgagctatgagtgtccaatgctggacgagggcgtggagcccgacgatgtggattgctggtgtaatacctccagcacatgggtggtgtacggcacctgtcaccacaagaagggagaggcacggagagcaaggagggcagtgacactgccttcccactctaccaggaagctgcagacacgctcccagacctggctggagtccagagagtataccaagcacctgatcagggtggagaactggatctttcgcaatccaggattcgcactggctgccgccgccatcgcatggctgctgggcagctccacctcccagaaagtgatctacctggtcatgatcctgctgatcgcccctgcctatagcatccggtgcatcggcgtgtccaatagagacttcgtggagggcatgtctggcggcacctgggtggatgtggtgctggagcacggcggctgcgtgacagtgatggcccaggacaagccaaccgtggatatcgagctggtgaccacaaccgtgtctaacatggccgaggtgcggagctactgctatgaggccagcatctccgacaacgcctctgatagcagatgtcccacccagggcgaggcctacctggacaagcagtctgatacacagtacgtgtgcaagcggaccctggtggacagaggcagcggcagcctggtgacatgcgccaagttcgcctgttccaagaagatgaccggcaagtctatccagccagagaacctggagtacaggatcatgctgagcgtgcacggctcccagcactctggcatgatcgtgaacgacacaggccacgagacagatgagaatagggccaaggtggagatcacacctaactctccaagggcagaggccaccctgggaggatttggcagcctgggcctggactgcgagcctaggacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggctcccaggagggagcagtgcacaccgccctggcaggcgccctggaggtggagatggacggagcaaagggccggctgtctagcggccacctgaagtgcagactgaagatggataagctgcagctgaagggcacaacctacggcgtgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggccggctgatcaccgcaaatccagtgatcacagagtctaccgagaacagcaagatgatgctggagctggaccccccttttggcgatagctatatcgtgatcggcgtgggcgagaagaagatcacacaccactggcacagaagcggctccaccctgggcaaggccttctctacaaccctgaagggagcacagagactggccgccctgggcgacaccgcctgggattttggctccatcggcggcgtgttcaactctatcggaagggcagtgcaccaggtgttcggaggcgcctttagaacactgttcggcggcatgagctggatcacccagggcctgatgggcgccctgctgctgtggatgggcgtgaatgccagggaccgctccatcgccctggcctttctggcaacaggaggcgtgctggtgttcctggccaccaacgtgcacgcctga

SEQ ID NO: 366 - DNA, 2091 bp, Artificial Sequence
  Synthetic
atgggaaagaggtctgccgggagtattatgtggctggcttcactggctgtcgtcatcgcctgtgctggagctgctgaggtcactaggcggggctccgcctactatatgtatctagacagaaatgatgccggcgaggtgatctcttttcccaccacactgggcatgaacaagtgctacatccagatcatggacctgggccacatgtgcgatgccaccatgagctatgagtgtccaatgctggacgagggcgtggagcccgacgatgtggattgctggtgtaatacctccagcacatgggtggtgtacggcacctgtcaccacaagaagggagaggcacggagagcaaggagggcagtgacactgccttcccactctaccaggaagctgcagacacgctcccagacctggctggagtccagagagtataccaagcacctgatcagggtggagaactggatctttcgcaatccaggattcgcactggctgccgccgccatcgcatggctgctgggcagctccacctcccagaaagtgatctacctggtcatgatcctgctgatcgcccctgcctatagcatccggtgcatcggcgtgtccaatagagacttcgtggagggcatgtctggcggcacctgggtggatgtggtgctggagcacggcggctgcgtgacagtgatggcccaggacaagccaaccgtggatatcgagctggtgaccacaaccgtgtctaacatggccgaggtgcggagctactgctatgaggccagcatctccgacaacgcctctgatagcagatgtcccacccagggcgaggcctacctggacaagcagtctgatacacagtacgtgtgcaagcggaccctggtggacagaggcagcggctccggctctggcagcggctccggctctagcctggtgacatgcgccaagttcgcctgttccaagaagatgaccggcaagtctatccagccagagaacctggagtacaggatcatgctgagcgtgcacggctcccagcactctggcatgatcgtgaacgacacaggccacgagacagatgagaatagggccaaggtggagatcacacctaactctccaagggcagaggccaccctgggaggatttggcagcctgggcctggactgcgagcctaggacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggctcccaggagggagcagtgcacaccgccctggcaggcgccctggaggtggagatggacggagcaaagggccgcctgtctagcggccacctgaagtgcaggctgaagatggataagctgcagctgaagggcacaacctacggcgtgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggccggctgatcaccgcaaatccagtgatcacagagtctaccgagaacagcaagatgatgctggagctggaccccccttttggcgatagctatatcgtgatcggcgtgggcgagaagaagatcacacaccactggcacagaagcggctcctccatcggcaaggccttcacaaccacactgaaaggagcacagagactggccgccctgggcgacaccgcatgggattttggctccgtgggaggcgtgttcacatctgtgggcaaggcagtgcaccaggtgttcggaggcgcctttagatctctgttcggcggcatgagctggatcacccagggcctgctgggcgccctgctgctgtggatgggcatcaacgcccgggacagatccatcgccctgacttttctggctgtcggcggagtgctgctgttcctgagcgtgaatgtccatgcctga

SEQ ID NO: 367 - DNA, 2091 bp, Artificial Sequence
  Synthetic
atgggaaagaggtctgccgggagtattatgtggctggcttcactggctgtcgtcatcgcctgtgctggagctgctgaggtcactaggcggggctccgcctactatatgtatctagacagaaatgatgccggcgaggtgatctcttttcccaccacactgggcatgaacaagtgctacatccagatcatggacctgggccacatgtgcgatgccaccatgagctatgagtgtccaatgctggacgagggcgtggagcccgacgatgtggattgctggtgtaatacctccagcacatgggtggtgtacggcacctgtcaccacaagaagggagaggcacggagagcaaggagggcagtgacactgccttcccactctaccaggaagctgcagacacgctcccagacctggctggagtccagagagtataccaagcacctgatcagggtggagaactggatctttcgcaatccaggattcgcactggctgccgccgccatcgcatggctgctgggcagctccacctcccagaaagtgatctacctggtcatgatcctgctgatcgcccctgcctatagcatccggtgcatcggcgtgtccaatagagacttcgtggagggcatgtctggcggcacctgggtggatgtggtgctggagcacggcggctgcgtgacagtgatggcccaggacaagccaaccgtggatatcgagctggtgaccacaaccgtgtctaacatggccgaggtgcggagctactgctatgaggccagcatctccgacaacgcctctgatagcagatgtcccacccagggcgaggcctacctggacaagcagtctgatacacagtacgtgtgcaagcggaccctggtggacagaggctggggcaatggctgtggcctgtttggcaacggcagcctggtgacatgcgccaagttcgcctgttccaagaagatgaccggcaagtctatccagccagagaacctggagtacaggatcatgctgagcgtgcacggctcccagcactctggcatgatcgtgaacgacacaggccacgagacagatgagaatagggccaaggtggagatcacacctaactctccaagggcagaggccaccctgggaggatttggcagcctgggcctggactgcgagcctaggacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggctcccaggagggagcagtgcacaccgccctggcaggcgccctggaggtggagatggacggagcaaagggccggctgtctagcggccacctgaagtgcagactgaagatggataagctgcagctgaagggcacaacctacggcgtgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggccggctgatcaccgcaaatccagtgatcacagagtctaccgagaacagcaagatgatgctggagctggaccccccttttggcgatagctatatcgtgatcggcgtgggcgagaagaagatcacacaccactggcacagaagcggctccaccctgggcaaggccttctctacaaccctgaagggagcacagagactggccgccctgggcgacaccgcctgggattttggctccatcggcggcgtgttcaactctatcggaagggcagtgcaccaggtgttcggaggcgcctttagaacactgttcggcggcatgagctggatcacccagggcctgatgggcgccctgctgctgtggatgggcgtgaatgccagggaccgctccatcgccctggcctttctggcaacaggaggcgtgctggtgttcctggccaccaacgtgcacgcctga

SEQ ID NO: 368 - DNA, 2091 bp, Artificial Sequence
  Synthetic
atgggaaagaggtctgccgggagtattatgtggctggcttcactggctgtcgtcatcgcctgtgctggagctgctgaggtcactaggcggggctccgcctactatatgtatctagacagaaatgatgccggcgaggtgatctcttttcccaccacactgggcatgaacaagtgctacatccagatcatggacctgggccacatgtgcgatgccaccatgagctatgagtgtccaatgctggacgagggcgtggagcccgacgatgtggattgctggtgtaatacctccagcacatgggtggtgtacggcacctgtcaccacaagaagggagaggcacggagagcaaggagggcagtgacactgccttcccactctaccaggaagctgcagacacgctcccagacctggctggagtccagagagtataccaagcacctgatcagggtggagaactggatctttcgcaatccaggattcgcactggctgccgccgccatcgcatggctgctgggcagctccacctcccagaaagtgatctacctggtcatgatcctgctgatcgcccctgcctatagcatccggtgcatcggcgtgtccaatagagacttcgtggagggcatgtctggcggcacctgggtggatgtggtgctggagcacggcggctgcgtgacagtgatggcccaggacaagccaaccgtggatatcgagctggtgaccacaaccgtgtctaacatggccgaggtgcggagctactgctatgaggccagcatctccgacaacgcctctgatagcagatgtcccacccagggcgaggcctacctggacaagcagtctgatacacagtacgtgtgcaagcggaccctggtggacagaggcagcggctccggctctggcagcggctccggctctagcctggtgacatgcgccaagttcgcctgttccaagaagatgaccggcaagtctatccagccagagaacctggagtacaggatcatgctgagcgtgcacggctcccagcactctggcatgatcgtgaacgacacaggccacgagacagatgagaatagggccaaggtggagatcacacctaactctccaagggcagaggccaccctgggaggatttggcagcctgggcctggactgcgagcctaggacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggctcccaggagggagcagtgcacaccgccctggcaggcgccctggaggtggagatggacggagcaaagggccgcctgtctagcggccacctgaagtgcaggctgaagatggataagctgcagctgaagggcacaacctacggcgtgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggccggctgatcaccgcaaatccagtgatcacagagtctaccgagaacagcaagatgatgctggagctggaccccccttttggcgatagctatatcgtgatcggcgtgggcgagaagaagatcacacaccactggcacagaagcggctcctccatcggcaaggccttcacaaccacactgaaaggagcacagagactggccgccctgggcgacaccgcatgggattttggctccgtgggaggcgtgttcacatctgtgggcaaggcagtgcaccagatcttcggcgccgcctttaagtccctgttcggcggcatgagctggttctcccagatcctgatcggcacactgctgatgtggctgggcctgaacaccaagaatggctctatcagcctgatgtgcctggctctgggaggggtcctgattttcctgtctaccgccgtgtccgcttga

SEQ ID NO: 369 - DNA, 2091 bp, Artificial Sequence
  Synthetic
atgggaaagaggtctgccgggagtattatgtggctggcttcactggctgtcgtcatcgcctgtgctggagctgctgaggtcactaggcggggctccgcctactatatgtatctagacagaaatgatgccggcgaggccatctcttttcccaccacactgggcatgaacaagtgctacatccagatcatggacctgggccacatgtgcgatgccaccatgagctatgagtgtccaatgctggacgagggcgtggagcccgacgatgtggattgctggtgtaataccacaagcacatgggtggtgtacggcacctgtcaccacaagaagggagaggcacggagagcaaggagggcagtgacactgccttcccactctaccaggaagctgcagacacgctcccagacctggctggagtccagagagtataccaagcacctgatcagggtggagaactggatctttcgcaatccaggattcgcactggctgccgccgccatcgcatggctgctgggcagctccacctcccagaaagtgatctacctggtcatgatcctgctgatcgcccctgcctatagcatccggtgcatcggcgtgtccaatagagacttcgtggagggcatgtctggcggcacctgggtggatgtggtgctggagcacggcggctgcgtgacagtgatggcccaggacaagccaaccgtggatatcgagctggtgaccacaaccgtgtctaacatggccgaggtgcggagctactgctatgaggccagcatctccgacatggcctctgatagcagatgtcccacccagggcgaggcctacctggacaagcagtctgatacacagtacgtgtgcaagcggaccctggtggacagaggcagcggctccggctctggcagcggctccggctctagcctggtgacatgcgccaagttcgcctgttccaagaagatgaccggcaagtctatccagccagagaacctggagtacaggatcatgctgagcgtgcacggctcccagcactctggcatgatcgtgaacgacacaggccacgagacagatgagaatagggccaaggtggagatcacacctaactctccaagggcagaggccaccctgggaggatttggcagcctgggcctggactgcgagcctaggacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggctcccaggagggagcagtgcacaccgccctggcaggcgccctggaggccgagatggacggagcaaagggccgcctgtctagcggccacctgaagtgcaggctgaagatggataagctgcgcctgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggccggctgatcaccgcaaatccagtgatcacagagtctaccgagaacagcaagatgatgctggagctggaccccccttttggcgatagctatatcgtgatcggcgtgggcgagaagaagatcacacaccactggcacagaagcggctccacaatcggcaaggcctttgaggcaaccgtgcggggagcaaagagaatggccgtgctgggcgacaccgcatgggatttcggcagcgtgggaggcgccctgaactccctgggcaagggcatccaccagatcttcggcgccgcctttaagtccctgttcggcggcatgagctggttctcccagatcctgatcggcacactgctgatgtggctgggcctgaacaccaagaatggctctatcagcctgatgtgcctggctctgggaggggtcctgattttcctgtctaccgccgtgtccgcttga

SEQ ID NO: 370 - DNA, 2091 bp, Artificial Sequence
  Synthetic
atgggaaagaggtctgccgggagtattatgtggctggcttcactggctgtcgtcatcgcctgtgctggagctgctgaggtcactaggcggggctccgcctactatatgtatctagacagaaatgatgccggcgaggccatctcttttcccaccacactgggcatgaacaagtgctacatccagatcatggacctgggccacatgtgcgatgccaccatgagctatgagtgtccaatgctggacgagggcgtggagcccgacgatgtggattgctggtgtaataccacaagcacatgggtggtgtacggcacctgtcaccacaagaagggagaggcacggagagcaaggagggcagtgacactgccttcccactctaccaggaagctgcagacacgctcccagacctggctggagtccagagagtataccaagcacctgatcagggtggagaactggatctttcgcaatccaggattcgcactggctgccgccgccatcgcatggctgctgggcagctccacctcccagaaagtgatctacctggtcatgatcctgctgatcgcccctgcctatagcatccggtgcatcggcgtgtccaatagagacttcgtggagggcatgtctggcggcacctgggtggatgtggtgctggagcacggcggctgcgtgacagtgatggcccaggacaagccaaccgtggatatcgagctggtgaccacaaccgtgtctaacatggccgaggtgcggagctactgctatgaggccagcatctccgacatggcctctgatagcagatgtcccacccagggcgaggcctacctggacaagcagtctgatacacagtacgtgtgcaagcggaccctggtggacagaggctggggcaatggctgtggcctgtttggcaagggcagcctggtgacatgcgccaagttcgcctgttccaagaagatgaccggcaagtctatccagccagagaacctggagtacaggatcatgctgagcgtgcacggctcccagcactctggcatgatcgtgaacgacacaggccacgagacagatgagaatagggccaaggtggagatcacacctaactctccaagggcagaggccaccctgggaggatttggcagcctgggcctggactgcgagcctaggacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggctcccaggagggagcagtgcacaccgccctggcaggcgccctggaggccgagatggacggagcaaagggccgcctgtctagcggccacctgaagtgcaggctgaagatggataagctgcgcctgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggccggctgatcaccgcaaatccagtgatcacagagtctaccgagaacagcaagatgatgctggagctggaccccccttttggcgatagctatatcgtgatcggcgtgggcgagaagaagatcacacaccactggcacagaagcggctccaccctgggcaaggccttctctacaaccctgaagggagcacagagactggccgccctgggcgacaccgcctgggattttggctccatcggcggcgtgttcaactctatcggaagggcagtgcaccaggtgttcggaggcgcctttagaacactgttcggcggcatgagctggatcacccagggcctgatgggcgccctgctgctgtggatgggcgtgaatgccagggaccgctccatcgccctggcctttctggcaacaggaggcgtgctggtgttcctggccaccaacgtgcacgcctga

SEQ ID NO: 371 - DNA, 2091 bp, Artificial Sequence
  Synthetic
atgggaaagaggtctgccgggagtattatgtggctggcttcactggctgtcgtcatcgcctgtgctggagctgctgaggtcactaggcggggctccgcctactatatgtatctagacagaaatgatgccggcgaggccatctcttttcccaccacactgggcatgaacaagtgctacatccagatcatggacctgggccacatgtgcgatgccaccatgagctatgagtgtccaatgctggacgagggcgtggagcccgacgatgtggattgctggtgtaataccacaagcacatgggtggtgtacggcacctgtcaccacaagaagggagaggcacggagagcaaggagggcagtgacactgccttcccactctaccaggaagctgcagacacgctcccagacctggctggagtccagagagtataccaagcacctgatcagggtggagaactggatctttcgcaatccaggattcgcactggctgccgccgccatcgcatggctgctgggcagctccacctcccagaaagtgatctacctggtcatgatcctgctgatcgcccctgcctatagcatccggtgcatcggcgtgtccaatagagacttcgtggagggcatgtctggcggcacctgggtggatgtggtgctggagcacggcggctgcgtgacagtgatggcccaggacaagccaaccgtggatatcgagctggtgaccacaaccgtgtctaacatggccgaggtgcggagctactgctatgaggccagcatctccgacaacgcctctgatagcagatgtcccacccagggcgaggcctacctggacaagcagtctgatacacagtacgtgtgcaagcggaccctggtggacagaggctggggcaatggctgtggcctgtttggcaagggcagcctggtgacatgcgccaagttcgcctgttccaagaagatgaccggcaagtctatccagccagagaacctggagtacaggatcatgctgagcgtgcacggctcccagcactctggcatgatcgtgaacgacacaggccacgagacagatgagaatagggccaaggtggagatcacacctaactctccaagggcagaggccaccctgggaggatttggcagcctgggcctggactgcgagcctaggacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggctcccaggagggagcagtgcacaccgccctggcaggcgccctggaggccgagatggacggagcaaagggccgcctgtctagcggccacctgaagtgcaggctgaagatggataagctgcgcctgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggccggctgatcaccgcaaatccagtgatcacagagtctaccgagaacagcaagatgatgctggagctggaccccccttttggcgatagctatatcgtgatcggcgtgggcgagaagaagatcacacaccactggcacagaagcggctccacaatcggcaaggcctttgaggcaaccgtgcggggagcaaagagaatggccgtgctgggcgacaccgcatgggatttcggcagcgtgggaggcgccctgaactccctgggcaagggcatccaccagatcttcggcgccgcctttaagtccctgttcggcggcatgagctggttctcccagatcctgatcggcacactgctgatgtggctgggcctgaacaccaagaatggctctatcagcctgatgtgcctggctctgggaggggtcctgattttcctgtctaccgccgtgtccgcttga

SEQ ID NO: 372 - DNA, 2091 bp, Artificial Sequence
  Synthetic
atgggaaagaggtctgccgggagtattatgtggctggcttcactggctgtcgtcatcgcctgtgctggagctgctgaggtcactaggcggggctccgcctactatatgtatctagacagaaatgatgccggcgaggccatctcttttcccaccacactgggcatgaacaagtgctacatccagatcatggacctgggccacatgtgcgatgccaccatgagctatgagtgtccaatgctggacgagggcgtggagcccgacgatgtggattgctggtgtaataccacaagcacatgggtggtgtacggcacctgtcaccacaagaagggagaggcacggagatccaggagggcagtgacactgccttcccactctaccaggaagctgcagacacgctcccagacctggctggagtccagagagtataccaagcacctgatcagggtggagaactggatctttcgcaatccaggattcgcactggctgccgccgccatcgcatggctgctgggcagctccacctcccagaaagtgatctacctggtcatgatcctgctgatcgcccctgcctatagcatccggtgcatcggcgtgtccaatagagacttcgtggagggcatgtctggcggcacctgggtggatgtggtgctggagcacggcggctgcgtgacagtgatggcccaggacaagccaaccgtggatatcgagctggtgaccacaaccgtgtctaacatggccgaggtgcggagctactgctatgaggccagcatctccgacatggcctctgatagcagatgtcccacccagggcgaggcctacctggacaagcagtctgatacacagtacgtgtgcaagcggaccctggtggacagaggcagcggctccggctctggcagcggctccggctctagcctggtgacatgcgccaagttcgcctgttccaagaagatgaccggcaagtctatccagccagagaacctggagtacaggatcatgctgagcgtgcacggctcccagcactctggcatgatcgtgaacgacacaggccacgagacagatgagaatagggccaaggtggagatcacacctaactctccaagggcagaggccaccctgggaggatttggcagcctgggcctggactgcgagcctaggacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggctcccaggagggagcagtgcacaccgccctggcaggcgccctggaggccgagatggacggagcaaagggccgcctgtctagcggccacctgaagtgcaggctgaagatggataagctgcagctgaagggcacaacctacggcgtgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggccggctgatcaccgcaaatccagtgatcacagagtctaccgagaacagcaagatgatgctggagctggaccccccttttggcgatagctatatcgtgatcggcgtgggcgagaagaagatcacacaccactggcacagaagcggctccacaatcggcaaggcctttgaggcaaccgtgcggggagcaaagagaatggccgtgctgggcgacaccgcatgggatttcggcagcgtgggaggcgccctgaactccctgggcaagggcatccaccagatcttcggcgccgcctttaagtccctgttcggcggcatgagctggttctcccagatcctgatcggcacactgctgatgtggctgggcctgaacaccaagaatggctctatcagcctgatgtgcctggctctgggaggggtcctgattttcctgtctaccgccgtgtccgcttga

SEQ ID NO: 373 - DNA, 2091 bp, Artificial Sequence
  Synthetic
atgggaaagaggtctgccgggagtattatgtggctggcttcactggctgtcgtcatcgcctgtgctggagctgctgaggtcactaggcggggctccgcctactatatgtatctagacagaaatgatgccggcgaggccatctcttttcccaccacactgggcatgaacaagtgctacatccagatcatggacctgggccacatgtgcgatgccaccatgagctatgagtgtccaatgctggacgagggcgtggagcccgacgatgtggattgctggtgtaataccacaagcacatgggtggtgtacggcacctgtcaccacaagaagggagaggcacggagatccaggagggcagtgacactgccttcccactctaccaggaagctgcagacacgctcccagacctggctggagtccagagagtataccaagcacctgatcagggtggagaactggatctttcgcaatccaggattcgcactggctgccgccgccatcgcatggctgctgggcagctccacctcccagaaagtgatctacctggtcatgatcctgctgatcgcccctgcctatagcatccggtgcatcggcgtgtccaatagagacttcgtggagggcatgtctggcggcacctgggtggatgtggtgctggagcacggcggctgcgtgacagtgatggcccaggacaagccaaccgtggatatcgagctggtgaccacaaccgtgtctaacatggccgaggtgcggagctactgctatgaggccagcatctccgacatggcctctgatagcagatgtcccacccagggcgaggcctacctggacaagcagtctgatacacagtacgtgtgcaagcggaccctggtggacagaggcagcggctccggctctggcagcggctccggctctagcctggtgacatgcgccaagttcgcctgttccaagaagatgaccggcaagtctatccagccagagaacctggagtacaggatcatgctgagcgtgcacggctcccagcactctggcatgatcgtgaacgacacaggccacgagacagatgagaatagggccaaggtggagatcacacctaactctccaagggcagaggccaccctgggaggatttggcagcctgggcctggactgcgagcctaggacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggctcccaggagggagcagtgcacaccgccctggcaggcgccctggaggccgagatggacggagcaaagggccgcctgtctagcggccacctgaagtgcaggctgaagatggataagctgcgcctgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggccggctgatcaccgcaaatccagtgatcacagagtctaccgagaacagcaagatgatgctggagctggaccccccttttggcgatagctatatcgtgatcggcgtgggcgagaagaagatcacacaccactggcacagaagcggctccaccctgggcaaggccttctctacaaccctgaagggagcacagagactggccgccctgggcgacaccgcctgggattttggctccatcggcggcgtgttcaactctatcggaagggcagtgcaccaggtgttcggaggcgcctttagaacactgttcggcggcatgagctggatcacccagggcctgatgggcgccctgctgctgtggatgggcgtgaatgccagggaccgctccatcgccctggcctttctggcaacaggaggcgtgctggtgttcctggccaccaacgtgcacgcctga

SEQ ID NO: 374 - DNA, 2091 bp, Artificial Sequence
  Synthetic
atgggaaagaggtctgccgggagtattatgtggctggcttcactggctgtcgtcatcgcctgtgctggagctgctgaggtcactaggcggggctccgcctactatatgtatctagacagaaatgatgccggcgaggccatctcttttcccaccacactgggcatgaacaagtgctacatccagatcatggacctgggccacatgtgcgatgccaccatgagctatgagtgtccaatgctggacgagggcgtggagcccgacgatgtggattgctggtgtaataccacaagcacatgggtggtgtacggcacctgtcaccacaagaagggagaggcacggagatccaggagggcagtgacactgccttcccactctaccaggaagctgcagacacgctcccagacctggctggagtccagagagtataccaagcacctgatcagggtggagaactggatctttcgcaatccaggattcgcactggctgccgccgccatcgcatggctgctgggcagctccacctcccagaaagtgatctacctggtcatgatcctgctgatcgcccctgcctatagcatccggtgcatcggcgtgtccaatagagacttcgtggagggcatgtctggcggcacctgggtggatgtggtgctggagcacggcggctgcgtgacagtgatggcccaggacaagccaaccgtggatatcgagctggtgaccacaaccgtgtctaacatggccgaggtgcggagctactgctatgaggccagcatctccgacaacgcctctgatagcagatgtcccacccagggcgaggcctacctggacaagcagtctgatacacagtacgtgtgcaagcggaccctggtggacagaggctggggcaatggctgtggcctgtttggcaagggcagcctggtgacatgcgccaagttcgcctgttccaagaagatgaccggcaagtctatccagccagagaacctggagtacaggatcatgctgagcgtgcacggctcccagcactctggcatgatcgtgaacgacacaggccacgagacagatgagaatagggccaaggtggagatcacacctaactctccaagggcagaggccaccctgggaggatttggcagcctgggcctggactgcgagcctaggacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggctcccaggagggagcagtgcacaccgccctggcaggcgccctggaggccgagatggacggagcaaagggccgcctgtctagcggccacctgaagtgcaggctgaagatggataagctgcgcctgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggccggctgatcaccgcaaatccagtgatcacagagtctaccgagaacagcaagatgatgctggagctggaccccccttttggcgatagctatatcgtgatcggcgtgggcgagaagaagatcacacaccactggcacagaagcggctccaccctgggcaaggccttctctacaaccctgaagggagcacagagactggccgccctgggcgacaccgcctgggattttggctccatcggcggcgtgttcaactctatcggaagggcagtgcaccaggtgttcggaggcgcctttagaacactgttcggcggcatgagctggatcacccagggcctgatgggcgccctgctgctgtggatgggcgtgaatgccagggaccgctccatcgccctggcctttctggcaacaggaggcgtgctggtgttcctggccaccaacgtgcacgcctga

SEQ ID NO: 375 - DNA, 2091 bp, Artificial Sequence
  Synthetic
atgggaaagaggtctgccgggagtattatgtggctggcttcactggctgtcgtcatcgcctgtgctggagctgctgaggtcactaggcggggctccgcctactatatgtatctagacagaaatgatgccggcgaggccatctcttttcccaccacactgggcatgaacaagtgctacatccagatcatggacctgggccacatgtgcgatgccaccatgagctatgagtgtccaatgctggacgagggcgtggagcccgacgatgtggattgctggtgtaataccacaagcacatgggtggtgtacggcacctgtcaccacaagaagggagaggcacggagatccaggagggcagtgacactgccttcccactctaccaggaagctgcagacacgctcccagacctggctggagtccagagagtataccaagcacctgatcagggtggagaactggatctttcgcaatccaggattcgcactggctgccgccgccatcgcatggctgctgggcagctccacctcccagaaagtgatctacctggtcatgatcctgctgatcgcccctgcctatagcatccggtgcatcggcgtgtccaatagagacttcgtggagggcatgtctggcggcacctgggtggatgtggtgctggagcacggcggctgcgtgacagtgatggcccaggacaagccaaccgtggatatcgagctggtgaccacaaccgtgtctaacatggccgaggtgcggagctactgctatgaggccagcatctccgacatggcctctgatagcagatgtcccacccagggcgaggcctacctggacaagcagtctgatacacagtacgtgtgcaagcggaccctggtggacagaggctggggcaatggctgtggcctgtttggcaagggcagcctggtgacatgcgccaagttcgcctgttccaagaagatgaccggcaagtctatccagccagagaacctggagtacaggatcatgctgagcgtgcacggctcccagcactctggcatgatcgtgaacgacacaggccacgagacagatgagaatagggccaaggtggagatcacacctaactctccaagggcagaggccaccctgggaggatttggcagcctgggcctggactgcgagcctaggacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggctcccaggagggagcagtgcacaccgccctggcaggcgccctggaggccgagatggacggagcaaagggccgcctgtctagcggccacctgaagtgcaggctgaagatggataagctgcagctgaagggcacaacctacggcgtgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggccggctgatcaccgcaaatccagtgatcacagagtctaccgagaacagcaagatgatgctggagctggaccccccttttggcgatagctatatcgtgatcggcgtgggcgagaagaagatcacacaccactggcacagaagcggctccaccctgggcaaggccttctctacaaccctgaagggagcacagagactggccgccctgggcgacaccgcctgggattttggctccatcggcggcgtgttcaactctatcggaagggcagtgcaccaggtgttcggaggcgcctttagaacactgttcggcggcatgagctggatcacccagggcctgatgggcgccctgctgctgtggatgggcgtgaatgccagggaccgctccatcgccctggcctttctggcaacaggaggcgtgctggtgttcctggccaccaacgtgcacgcctga

SEQ ID NO: 376 - DNA, 2091 bp, Artificial Sequence
  Synthetic
atgggaaagaggtctgccgggagtattatgtggctggcttcactggctgtcgtcatcgcctgtgctggagctgctgaggtcactaggcggggctccgcctactatatgtatctagacagaaatgatgccggcgaggccatctcttttcccaccacactgggcatgaacaagtgctacatccagatcatggacctgggccacatgtgcgatgccaccatgagctatgagtgtccaatgctggacgagggcgtggagcccgacgatgtggattgctggtgtaataccacaagcacatgggtggtgtacggcacctgtcaccacaagaagggagaggcacggagatccaggagggcagtgacactgccttcccactctaccaggaagctgcagacacgctcccagacctggctggagtccagagagtataccaagcacctgatcagggtggagaactggatctttcgcaatccaggattcgcactggctgccgccgccatcgcatggctgctgggcagctccacctcccagaaagtgatctacctggtcatgatcctgctgatcgcccctgcctatagcatccggtgcatcggcgtgtccaatagagacttcgtggagggcatgtctggcggcacctgggtggatgtggtgctggagcacggcggctgcgtgacagtgatggcccaggacaagccaaccgtggatatcgagctggtgaccacaaccgtgtctaacatggccgaggtgcggagctactgctatgaggccagcatctccgacatggcctctgatagcagatgtcccacccagggcgaggcctacctggacaagcagtctgatacacagtacgtgtgcaagcggaccctggtggacagaggctggggcaatggctgtggcctgtttggcaagggcagcctggtgacatgcgccaagttcgcctgttccaagaagatgaccggcaagtctatccagccagagaacctggagtacaggatcatgctgagcgtgcacggctcccagcactctggcatgatcgtgaacgacacaggccacgagacagatgagaatagggccaaggtggagatcacacctaactctccaagggcagaggccaccctgggaggatttggcagcctgggcctggactgcgagcctaggacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggctcccaggagggagcagtgcacaccgccctggcaggcgccctggaggtggagatggacggagcaaagggccgcctgtctagcggccacctgaagtgcaggctgaagatggataagctgcgcctgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggccggctgatcaccgcaaatccagtgatcacagagtctaccgagaacagcaagatgatgctggagctggaccccccttttggcgatagctatatcgtgatcggcgtgggcgagaagaagatcacacaccactggcacagaagcggctccaccctgggcaaggccttctctacaaccctgaagggagcacagagactggccgccctgggcgacaccgcctgggattttggctccatcggcggcgtgttcaactctatcggaagggcagtgcaccaggtgttcggaggcgcctttagaacactgttcggcggcatgagctggatcacccagggcctgatgggcgccctgctgctgtggatgggcgtgaatgccagggaccgctccatcgccctggcctttctggcaacaggaggcgtgctggtgttcctggccaccaacgtgcacgcctga

SEQ ID NO: 377 - DNA, 2091 bp, Artificial Sequence
  Synthetic
atgggaaagaggtctgccgggagtattatgtggctggcttcactggctgtcgtcatcgcctgtgctggagctgctgaggtcactaggcggggctccgcctactatatgtatctagacagaaatgatgccggcgaggccatctcttttcccaccacactgggcatgaacaagtgctacatccagatcatggacctgggccacatgtgcgatgccaccatgagctatgagtgtccaatgctggacgagggcgtggagcccgacgatgtggattgctggtgtaataccacaagcacatgggtggtgtacggcacctgtcaccacaagaagggagaggcacggagatccaggagggcagtgacactgccttcccactctaccaggaagctgcagacacgctcccagacctggctggagtccagagagtataccaagcacctgatcagggtggagaactggatctttcgcaatccaggattcgcactggctgccgccgccatcgcatggctgctgggcagctccacctcccagaaagtgatctacctggtcatgatcctgctgatcgcccctgcctatagcatccggtgcatcggcgtgtccaatagagacttcgtggagggcatgtctggcggcacctgggtggatgtggtgctggagcacggcggctgcgtgacagtgatggcccaggacaagccaaccgtggatatcgagctggtgaccacaaccgtgtctaacatggccgaggtgcggagctactgctatgaggccagcatctccgacatggcctctgatagcagatgtcccacccagggcgaggcctacctggacaagcagtctgatacacagtacgtgtgcaagcggaccctggtggacagaggctggggcaatggctgtggcctgtttggcaagggcagcctggtgacatgcgccaagttcgcctgttccaagaagatgaccggcaagtctatccagccagagaacctggagtacaggatcatgctgagcgtgcacggctcccagcactctggcatgatcgtgaacgacacaggccacgagacagatgagaatagggccaaggtggagatcacacctaactctccaagggcagaggccaccctgggaggatttggcagcctgggcctggactgcgagcctaggacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggctcccaggagggagcagtgcacaccgccctggcaggcgccctggaggccgagatggacggagcaaagggccgcctgtctagcggccacctgaagtgcaggctgaagatggataagctgcgcctgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggccggctgatcaccgcaaatccagtgatcacagagtctaccgagaacagcaagatgatgctggagctggaccccccttttggcgatagctatatcgtgatcggcgtgggcgagaagaagatcacacaccactggcacagaagcggctccacaatcggcaaggcctttgaggcaaccgtgcggggagcaaagagaatggccgtgctgggcgacaccgcatgggatttcggcagcgtgggaggcgtgttcaactccctgggcaagggcatccaccagatcttcggcgccgcctttaagtccctgttcggcggcatgagctggttctcccagatcctgatcggcacactgctggtgtggctgggcctgaacaccaagaatggctctatcagcctgacctgcctggctctgggaggggtcatgattttcctgtctaccgccgtgtccgcttga

SEQ ID NO: 378 - DNA, 2091 bp, Artificial Sequence
  Synthetic
atgggaaagaggtctgccgggagtattatgtggctggcttcactggctgtcgtcatcgcctgtgctggagctgctgaggtcactaggcggggctccgcctactatatgtatctagacagaaatgatgccggcgaggccatctcttttcccaccacactgggcatgaacaagtgctacatccagatcatggacctgggccacatgtgcgatgccaccatgagctatgagtgtccaatgctggacgagggcgtggagcccgacgatgtggattgctggtgtaataccacaagcacatgggtggtgtacggcacctgtcaccacaagaagggagaggcacggagatccaggagggcagtgacactgccttcccactctaccaggaagctgcagacacgctcccagacctggctggagtccagagagtataccaagcacctgatcagggtggagaactggatctttcgcaatccaggattcgcactggtggccgtggccatcgcatggctgctgggcagctccacctcccagaaagtgatctacctggtcatgatcctgctgatcgcccctgcctatagcatccggtgcatcggcgtgtccaatagagacttcgtggagggcatgtctggcggcacctgggtggatgtggtgctggagcacggcggctgcgtgacagtgatggcccaggacaagccaaccgtggatatcgagctggtgaccacaaccgtgtctaacatggccgaggtgcggagctactgctatgaggccagcatctccgacatggcctctgatagcagatgtcccacccagggcgaggcctacctggacaagcagtctgatacacagtacgtgtgcaagcggaccctggtggacagaggctggggcaatggctgtggcctgtttggcaagggcagcctggtgacatgcgccaagttcgcctgttccaagaagatgaccggcaagtctatccagccagagaacctggagtacaggatcatgctgagcgtgcacggctcccagcactctggcatgatcgtgaacgacacaggccacgagacagatgagaatagggccaaggtggagatcacacctaactctccaagggcagaggccaccctgggaggatttggcagcctgggcctggactgcgagcctaggacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggctcccaggagggagcagtgcacaccgccctggcaggcgccctggaggccgagatggacggagcaaagggccgcctgtctagcggccacctgaagtgcaggctgaagatggataagctgcgcctgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggccggctgatcaccgcaaatccagtgatcacagagtctaccgagaacagcaagatgatgctggagctggaccccccttttggcgatagctatatcgtgatcggcgtgggcgagaagaagatcacacaccactggcacagaagcggctccacaatcggcaaggcctttgaggcaaccgtgcggggagcaaagagaatggccgtgctgggcgacaccgcatgggatttcggcagcgtgggaggcgtgttcaactccctgggcaagggcatccaccagatcttcggcgccgcctttaagtccctgttcggcggcatgagctggttctcccagatcctgatcggcacactgctggtgtggctgggcctgaacaccaagaatggctctatcagcctgacctgcctggctctgggaggggtcatgattttcctgtctaccgccgtgtccgcttga

SEQ ID NO: 379 - DNA, 2091 bp, Artificial Sequence; identical to SEQ ID NO: 355
  Synthetic

SEQ ID NO: 380 - DNA, 2091 bp, Artificial Sequence
  Synthetic
atgggcaagcggtccgccggctctatcatgtggctggcctctctggccgtggtcatcgcatgcgcaggagcagcggaggtcaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtaggctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 381 - DNA, 2091 bp, Artificial Sequence
  Synthetic
atgggcaagcggtccgccggctctatcatgtggctggcctctctggccgtggtcatcgcatgcgcaggagcagcggaggtcaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtggcgactttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 382 - DNA, 2091 bp, Artificial Sequence
  Synthetic
atgggcaagcggtccgccggctctatcatgtggctggcctctctggccgtggtcatcgcatgcgcaggagcagcggaggtcaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtagggactttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 383 - DNA, 2091 bp, Artificial Sequence
  Synthetic
atgggcaagcggtccgccggctctatcatgtggctggcctctctggccgtggtcatcgcatgcgcaggagcagcggaggtcaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccgccggcggcgaggcctacctggacaagcagtctgatacacagtacgtgtgcaagaggaccctggtggacaggggaaggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 384 - DNA, 2091 bp, Artificial Sequence
  Synthetic
atgggcaagcggtccgccggctctatcatgtggctggcctctctggccgtggtcatcgcatgcgcaggagcagcggaggtcaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccgccggcggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 385 - DNA, 2091 bp, Artificial Sequence
  Synthetic
atgggcaagcggtccgccggctctatcatgtggctggcctctctggccgtggtcatcgcatgcgcaggagcagcggaggtcaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccgccggcggcgaggcctacctggacaagcagtctgatacacagtacgtgtgcaagaggaccctggtggacaggggaaggggaaatggatgtagggactttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 386 - DNA, 2091 bp, Artificial Sequence
  Synthetic
atgggcaagcggtccgccggctctatcatgtggctggcctctctggccgtggtcatcgcatgcgcaggagcagcggaggtcaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggaaggggaaatggatgtagggactttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 387 - DNA, 2091 bp, Artificial Sequence
  Synthetic
atgggcaagcggtccgccggctctatcatgtggctggcctctctggccgtggtcatcgcatgcgcaggagcagcggaggtcaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccgcccagggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 388 - DNA, 2091 bp, Artificial Sequence
  Synthetic
atgggcaagcggtccgccggctctatcatgtggctggcctctctggccgtggtcatcgcatgcgcaggagcagcggaggtcaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccaccggcggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 389 - DNA, 2091 bp, Artificial Sequence
  Synthetic
atgggcaagcggtccgccggctctatcatgtggctggcctctctggccgtggtcatcgcatgcgcaggagcagcggaggtcaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggaaggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 390 - DNA, 2091 bp, Artificial Sequence
  Synthetic
atgggcaagcggtccgccggctctatcatgtggctggcctctctggccgtggtcatcgcatgcgcaggagcagcggaggtcaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccgccaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 391 - DNA, 2091 bp, Artificial Sequence
  Synthetic
atgggcaagcggtccgccggctctatcatgtggctggcctctctggccgtggtcatcgcatgcgcaggagcagcggaggtcaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagagggccacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 392 - DNA, 2091 bp, Artificial Sequence
  Synthetic
atgggcaagcggtccgccggctctatcatgtggctggcctctctggccgtggtcatcgcatgcgcaggagcagcggaggtcaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtggccaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 393 - DNA, 2091 bp, Artificial Sequence
  Synthetic
atgggcaagcggtccgccggctctatcatgtggctggcctctctggccgtggtcatcgcatgcgcaggagcagcggaggtcaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggccggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 394 - DNA, 2091 bp, Artificial Sequence
  Synthetic
atgggcaagcggtccgccggctctatcatgtggctggcctctctggccgtggtcatcgcatgcgcaggagcagcggaggtcaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagccgtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 395 - DNA, 2091 bp, Artificial Sequence
  Synthetic
atgggcaagcggtccgccggctctatcatgtggctggcctctctggccgtggtcatcgcatgcgcaggagcagcggaggtcaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggccgtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 396 - DNA, 2091 bp, Artificial Sequence
  Synthetic
atgggcaagcggtccgccggctctatcatgtggctggcctctctggccgtggtcatcgcatgcgcaggagcagcggaggtcaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggccctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 397 - DNA, 2091 bp, Artificial Sequence
  Synthetic
atgggcaagcggtccgccggctctatcatgtggctggcctctctggccgtggtcatcgcatgcgcaggagcagcggaggtcaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagcgccgagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 398 - DNA, 2091 bp, Artificial Sequence
  Synthetic
atgggcaagcggtccgccggctctatcatgtggctggcctctctggccgtggtcatcgcatgcgcaggagcagcggaggtcaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggccaagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 399 - DNA, 2091 bp, Artificial Sequence
  Synthetic
atgggcaagcggtccgccggctctatcatgtggctggcctctctggccgtggtcatcgcatgcgcaggagcagcggaggtcaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggatgccctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 400 - DNA, 2091 bp, Artificial Sequence
  Synthetic
atgggcaagcggtccgccggctctatcatgtggctggcctctctggccgtggtcatcgcatgcgcaggagcagcggaggtcaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagagccaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 401 - DNA, 2091 bp, Artificial Sequence
  Synthetic
atgggcaagcggtccgccggctctatcatgtggctggcctctctggccgtggtcatcgcatgcgcaggagcagcggaggtcaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtggcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 402 - DNA, 2091 bp, Artificial Sequence
  Synthetic
atgggcaagcggtccgccggctctatcatgtggctggcctctctggccgtggtcatcgcatgcgcaggagcagcggaggtcaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtccgcctctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 403 - DNA, 2091 bp, Artificial Sequence
  Synthetic
atgggcaagcggtccgccggctctatcatgtggctggcctctctggccgtggtcatcgcatgcgcaggagcagcggaggtcaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctgcctgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 404 - DNA, 2091 bp, Artificial Sequence
  Synthetic
atgggcaagcggtccgccggctctatcatgtggctggcctctctggccgtggtcatcgcatgcgcaggagcagcggaggtcaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcgcctgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 405 - DNA, 2091 bp, Artificial Sequence
  Synthetic
atgggcaagcggtccgccggctctatcatgtggctggcctctctggccgtggtcatcgcatgcgcaggagcagcggaggtcaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcgccgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 406 - DNA, 2091 bp, Artificial Sequence
  Synthetic
atgggcaagcggtccgccggctctatcatgtggctggcctctctggccgtggtcatcgcatgcgcaggagcagcggaggtcaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctgcccgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 407 - DNA, 2091 bp, Artificial Sequence
  Synthetic
atgggcaagcggtccgccggctctatcatgtggctggcctctctggccgtggtcatcgcatgcgcaggagcagcggaggtcaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatggccggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 408 - DNA, 2091 bp, Artificial Sequence
  Synthetic
atgggcaagcggtccgccggctctatcatgtggctggcctctctggccgtggtcatcgcatgcgcaggagcagcggaggtcaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacgccggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 409 - DNA, 2091 bp, Artificial Sequence
  Synthetic
atgggcaagcggtccgccggctctatcatgtggctggcctctctggccgtggtcatcgcatgcgcaggagcagcggaggtcaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatgggcgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 410 - DNA, 2091 bp, Artificial Sequence
  Synthetic
atgggcaagcggtccgccggctctatcatgtggctggcctctctggccgtggtcatcgcatgcgcaggagcagcggaggtcaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgccacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 411 - DNA, 2091 bp, Artificial Sequence
  Synthetic
atgggcaagcggtccgccggctctatcatgtggctggcctctctggccgtggtcatcgcatgcgcaggagcagcggaggtcaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagaggccctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 412 - DNA, 2091 bp, Artificial Sequence
  Synthetic
atgggcaagcggtccgccggctctatcatgtggctggcctctctggccgtggtcatcgcatgcgcaggagcagcggaggtcaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcgcccctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 413 - DNA, 2091 bp, Artificial Sequence
  Synthetic
atgggcaagcggtccgccggctctatcatgtggctggcctctctggccgtggtcatcgcatgcgcaggagcagcggaggtcaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgccgccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 414 - DNA, 2091 bp, Artificial Sequence
  Synthetic
atgggcaagcggtccgccggctctatcatgtggctggcctctctggccgtggtcatcgcatgcgcaggagcagcggaggtcaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgaggccgatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 415 - DNA, 2091 bp, Artificial Sequence
  Synthetic
atgggcaagcggtccgccggctctatcatgtggctggcctctctggccgtggtcatcgcatgcgcaggagcagcggaggtcaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctgccacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 416 - DNA, 2091 bp, Artificial Sequence
  Synthetic
atgggcaagcggtccgccggctctatcatgtggctggcctctctggccgtggtcatcgcatgcgcaggagcagcggaggtcaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcgccctgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 417 - DNA, 2091 bp, Artificial Sequence
  Synthetic
atgggcaagcggtccgccggctctatcatgtggctggcctctctggccgtggtcatcgcatgcgcaggagcagcggaggtcaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccagcccacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 418 - DNA, 2091 bp, Artificial Sequence
  Synthetic
atgggcaagcggtccgccggctctatcatgtggctggcctctctggccgtggtcatcgcatgcgcaggagcagcggaggtcaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatgccggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 419 - DNA, 2091 bp, Artificial Sequence
  Synthetic
atgggcaagcggtccgccggctctatcatgtggctggcctctctggccgtggtcatcgcatgcgcaggagcagcggaggtcaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccgccatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 420 - DNA, 2091 bp, Artificial Sequence
  Synthetic
atgggcaagcggtccgccggctctatcatgtggctggcctctctggccgtggtcatcgcatgcgcaggagcagcggaggtcaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgccacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 421 - DNA, 2091 bp, Artificial Sequence
  Synthetic
atgggcaagcggtccgccggctctatcatgtggctggcctctctggccgtggtcatcgcatgcgcaggagcagcggaggtcaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccagaaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 422 - DNA, 2091 bp, Artificial Sequence
  Synthetic
atgggcaagcggtccgccggctctatcatgtggctggcctctctggccgtggtcatcgcatgcgcaggagcagcggaggtcaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagagggagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 423 - DNA, 2091 bp, Artificial Sequence
  Synthetic
atgggcaagcggtccgccggctctatcatgtggctggcctctctggccgtggtcatcgcatgcgcaggagcagcggaggtcaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccagcagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 424 - DNA, 2091 bp, Artificial Sequence
  Synthetic
atgggcaagcggtccgccggctctatcatgtggctggcctctctggccgtggtcatcgcatgcgcaggagcagcggaggtcaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacaatcgtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 425 - DNA, 2091 bp, Artificial Sequence
  Synthetic
atgggcaagcggtccgccggctctatcatgtggctggcctctctggccgtggtcatcgcatgcgcaggagcagcggaggtcaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtgatcgtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 426 - DNA, 2091 bp, Artificial Sequence
  Synthetic
atgggcaagcggtccgccggctctatcatgtggctggcctctctggccgtggtcatcgcatgcgcaggagcagcggaggtcaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtgatcctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 427 - DNA, 2091 bp, Artificial Sequence
  Synthetic
atgggcaagcggtccgccggctctatcatgtggctggcctctctggccgtggtcatcgcatgcgcaggagcagcggaggtcaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagcgaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 428 - DNA, 2091 bp, Artificial Sequence
  Synthetic
atgggcaagcggtccgccggctctatcatgtggctggcctctctggccgtggtcatcgcatgcgcaggagcagcggaggtcaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatgaacaagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 429 - DNA, 2091 bp, Artificial Sequence
  Synthetic
atgggcaagcggtccgccggctctatcatgtggctggcctctctggccgtggtcatcgcatgcgcaggagcagcggaggtcaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggatagactgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 430 - DNA, 2091 bp, Artificial Sequence
  Synthetic
atgggcaagcggtccgccggctctatcatgtggctggcctctctggccgtggtcatcgcatgcgcaggagcagcggaggtcaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagaatcaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 431 - DNA, 2091 bp, Artificial Sequence
  Synthetic
atgggcaagcggtccgccggctctatcatgtggctggcctctctggccgtggtcatcgcatgcgcaggagcagcggaggtcaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgacctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 432 - DNA, 2091 bp, Artificial Sequence
  Synthetic
atgggcaagcggtccgccggctctatcatgtggctggcctctctggccgtggtcatcgcatgcgcaggagcagcggaggtcaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtccttctctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 433 - DNA, 2091 bp, Artificial Sequence
  Synthetic
atgggcaagcggtccgccggctctatcatgtggctggcctctctggccgtggtcatcgcatgcgcaggagcagcggaggtcaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctatctgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 434 - DNA, 2091 bp, Artificial Sequence
  Synthetic
atgggcaagcggtccgccggctctatcatgtggctggcctctctggccgtggtcatcgcatgcgcaggagcagcggaggtcaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaagtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 435 - DNA, 2091 bp, Artificial Sequence
  Synthetic
atgggcaagcggtccgccggctctatcatgtggctggcctctctggccgtggtcatcgcatgcgcaggagcagcggaggtcaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcagcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 436 - DNA, 2091 bp, Artificial Sequence
  Synthetic
atgggcaagcggtccgccggctctatcatgtggctggcctctctggccgtggtcatcgcatgcgcaggagcagcggaggtcaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctgaccgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 437 - DNA, 2091 bp, Artificial Sequence
  Synthetic
atgggcaagcggtccgccggctctatcatgtggctggcctctctggccgtggtcatcgcatgcgcaggagcagcggaggtcaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgaccggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 438 - DNA, 2091 bp, Artificial Sequence
  Synthetic
atgggcaagcggtccgccggctctatcatgtggctggcctctctggccgtggtcatcgcatgcgcaggagcagcggaggtcaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacagcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 439 - DNA, 2091 bp, Artificial Sequence
  Synthetic
atgggcaagcggtccgccggctctatcatgtggctggcctctctggccgtggtcatcgcatgcgcaggagcagcggaggtcaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatgagcgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 440 - DNA, 2091 bp, Artificial Sequence
  Synthetic
atgggcaagcggtccgccggctctatcatgtggctggcctctctggccgtggtcatcgcatgcgcaggagcagcggaggtcaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctaacacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 441 - DNA, 2091 bp, Artificial Sequence
  Synthetic
atgggcaagcggtccgccggctctatcatgtggctggcctctctggccgtggtcatcgcatgcgcaggagcagcggaggtcaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagaggacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 442 - DNA, 2091 bp, Artificial Sequence
  Synthetic
atgggcaagcggtccgccggctctatcatgtggctggcctctctggccgtggtcatcgcatgcgcaggagcagcggaggtcaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcagccctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 443 - DNA, 2091 bp, Artificial Sequence
  Synthetic
atgggcaagcggtccgccggctctatcatgtggctggcctctctggccgtggtcatcgcatgcgcaggagcagcggaggtcaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgcccaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 444 - DNA, 2091 bp, Artificial Sequence
  Synthetic
atgggcaagcggtccgccggctctatcatgtggctggcctctctggccgtggtcatcgcatgcgcaggagcagcggaggtcaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagagcgatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 445 - DNA, 2091 bp, Artificial Sequence
  Synthetic
atgggcaagcggtccgccggctctatcatgtggctggcctctctggccgtggtcatcgcatgcgcaggagcagcggaggtcaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctaagacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 446 - DNA, 2091 bp, Artificial Sequence
  Synthetic
atgggcaagcggtccgccggctctatcatgtggctggcctctctggccgtggtcatcgcatgcgcaggagcagcggaggtcaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcggcctgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 447 - DNA, 2091 bp, Artificial Sequence
  Synthetic
atgggcaagcggtccgccggctctatcatgtggctggcctctctggccgtggtcatcgcatgcgcaggagcagcggaggtcaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccattccacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 448 - DNA, 2091 bp, Artificial Sequence
  Synthetic
atgggcaagcggtccgccggctctatcatgtggctggcctctctggccgtggtcatcgcatgcgcaggagcagcggaggtcaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatagcggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 449 - DNA, 2091 bp, Artificial Sequence
  Synthetic
atgggcaagcggtccgccggctctatcatgtggctggcctctctggccgtggtcatcgcatgcgcaggagcagcggaggtcaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccagaatccctgccgagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

SEQ ID NO: 450 - DNA, 2091 bp, Artificial Sequence
  Synthetic
atgggcaagcggtccgccggctctatcatgtggctggcctctctggccgtggtcatcgcatgcgcaggagcagcggaggtcaccaggagaggcagcgcctactatatgtacctggacagaaatgatgccggcgaggccatcagctttcccaccacactgggcatgaacaagtgttacatccagatcatggacctgggccacatgtgcgatgccaccatgtcctatgagtgtccaatgctggacgagggcgtggagcccgacgatgtggattgctggtgtaataccacatccacatgggtggtgtacggcacctgccaccacaagaagggagaggcaaggcgctctcggagagcagtgacactgccttcccactctacccggaagctgcagacaagatctcagacctggctggagagccgggagtatacaaagcacctgatccgggtggagaactggatctttagaaatccaggattcgcactggcagcagcagcaatcgcatggctgctgggcagctccacctcccagaaagtgatctacctggtcatgatcctgctgatcgcccctgcctattccatcaggtgcatcggcgtgtctaatcgcgacttcgtggagggcatgtctggcggcacctgggtggatgtggtgctggagcacggcggctgcgtgacagtgatggcccaggacaagccaaccgtggacatcgagctggtgaccacaaccgtgagcaacatggccgaggtgcggtcctactgctatgaggccagcatctccgacatggcctctgatagcagatgtcccacccagggcgaggcctacctggacaagcagtctgatacacagtacgtgtgcaagaggaccctggtggacaggggatggggaaatggatgtggcctgtttggcaagggcagcctggtgacatgcgccaagttcgcctgttctaagaagatgaccggcaagagcatccagccagagaacctggagtaccggatcatgctgagcgtgcacggcagccagcactccggcatgatcgtgaacgacacaggccacgagacagatgagaatagggccaaggtggagatcacacctaacagcccacgcgccgaggccaccctgggaggatttggctccctgggcctggactgcgagcctagaacaggcctggacttctccgatctgtactatctgaccatgaacaataagcactggctggtgcacaaggagtggtttcacgacatcccactgccatggcacgcaggagcagatacaggaaccccacactggaacaataaggaggccctggtggagttcaaggatgcccacgccaagaggcagacagtggtggtgctgggcagccaggagggagcagtgcacaccgccctggcaggcgccctggaggccgagatggacggagcaaagggccgcctgtctagcggccacctgaagtgccggctgaagatggataagctgagactgaagggcgtgtcctactctctgtgcacagccgccttcaccttcaccaagatccctgcccagacactgcacggcacagtgaccgtggaggtgcagtatgccggcacagacggcccctgtaaggtgcctgcccagatggccgtggatatgcagacactgacccctgtgggcaggctgatcaccgccaatccagtgatcacagagtccaccgagaactctaagatgatgctggagctggaccccccttttggcgatagctatatcgtgatcggcgtgggcgagaagaagatcacacaccactggcaccgcagcggctccacaatcggcaaggcctttgaggccaccgtgaggggagcaaagaggatggccgtgctgggcgacaccgcatgggatttcggctccgtgggaggcgccctgaactctctgggcaagggcatccaccagatcttcggcgccgcctttaagtccctgttcggcggcatgtcttggtttagccagatcctgatcggcacactgctgatgtggctgggcctgaacaccaagaatggctctatcagcctgatgtgcctggccctgggaggcgtgctgatcttcctgagcaccgccgtgtccgcctga

What is claimed:

1. A nucleic acid molecule comprising a nucleotide sequence encoding a polyprotein, wherein the polyprotein comprises at least a portion of a Zika virus prM protein joined to at least a portion of a Zika virus envelope (E) protein, wherein the at least a portion of a Zika virus prM protein comprises a signal sequence that is heterologous to Zika virus; and, wherein the at least a portion of the Zika virus envelope protein comprises envelope protein stem and/or transmembrane domain(s) from a flavivirus other than Zika virus.

2. The nucleic acid molecule of claim 1, wherein the heterologous signal sequence is from a protein selected from the group consisting of flavivirus prM protein, human CD5 protein, mouse IL-2 protein, and bovine prolactin.

3. The nucleic acid molecule of claim 2, wherein the flavivirus is selected from the group consisting of Japanese encephalitis virus, yellow fever virus, Dengue virus, and West Nile Virus.

4. The nucleic acid molecule of claim 1, wherein the stem and/or membrane domain(s) are/is from the envelope protein of Japanese Encephalitis Virus.

5. The nucleic acid molecule of claim 1, wherein the heterologous signal sequence comprises the Japanese Encephalitis Virus envelope protein signal sequence.

6. The nucleic acid molecule of claim 1, wherein the Zika virus prM protein comprises an amino acid sequence at least 80%, at least 85%, at least 90%, at least 95%, or at least 97% identical to a Zika virus prM protein sequence selected from the group consisting of SEQ ID NO:29-SEQ ID NO:239, and wherein the prM protein comprises at least one mutation from the protein sequence selected from the group consisting of SEQ ID NO:29-SEQ ID NO:239.

7. The nucleic acid molecule of claim 1, wherein the polyprotein comprises an amino acid sequence at least 80%, at least 85%, at least 90%, at least 95%, or at least 97% identical to SEQ ID NO:110 or SEQ ID NO:114.

8. A method of producing a Zika virus-like particle, the method comprising introducing into a cell the nucleic acid molecule of claim 1, such that the encoded polyprotein is expressed.

9. A method of eliciting an immune response against Zika virus in an individual, the method comprising administering to the individual the nucleic acid molecule of claim 1.

10. The nucleic acid molecule of claim 1, wherein the signal sequence comprises an amino acid sequence at least 90% identical to SEQ ID NO:18, SEQ ID NO:20, SEQ ID NO:22, SEQ ID NO:24, or SEQ ID NO:26.

11. The nucleic acid molecule of claim 1, wherein the at least a portion of a Zika virus prM protein comprises at least 50 contiguous amino acid residues having a sequence at least 80%% identical to at least 50 contiguous amino acid residues from SEQ ID NO:2.

12. The nucleic acid molecule of claim 1, wherein the at least a portion of a Zika virus prM protein comprises an amino acid sequence at least 80%% identical to SEQ ID NO:2.

13. The nucleic acid molecule of claim 1, wherein the at least a portion of a Zika virus envelope protein comprises at least 50 contiguous amino acid residues having a sequence at least 80%% identical to at least 50 contiguous amino acid residues from SEQ ID NO:4.

14. The nucleic acid molecule of claim 1, wherein the at least a portion of a Zika virus prM protein comprises an amino acid sequence at least 80%% identical to SEQ ID NO:4.

15. The nucleic acid molecule of claim 4, wherein the stem domain comprises an amino acid sequence at least 85% identical to SEQ ID NO:8.

16. The nucleic acid molecule of claim 4, wherein the transmembrane domain comprises an amino acid sequence at least 85% identical to SEQ ID NO:8.

17. The nucleic acid molecule of claim 4, wherein the region corresponding to the stem/transmembrane domains comprise an amino acid sequence at least 85% identical to SEQ ID NO:16.

18. A kit comprising the nucleic acid molecule of claim 1.

19. The nucleic acid molecule of claim 1, wherein the polyprotein comprises at least one mutation selected from the group consisting of;
　a. a mutation in the at least a portion of a Zika virus prM protein, at a position corresponding to amino acid position H7 of SEQ ID NO:2;
　b. a mutation in the at least a portion of a Zika virus envelope protein, at a position corresponding to an amino acid position selected from the group consisting of R2, G5, N8, S16, G28, A54, T76, Q77, D87, W101, G106, L107, N134, T160, T170, E177, R193, P222, W225, T231, K251, Q253, V255, V256, V257, Q261, E262, H266, E262, D296, K297, L300, 5304, Y305, L307, K316, and E320, of SEQ ID NO:4.

20. The nucleic acid molecule of claim 1, wherein the polyprotein comprises an amino acid sequence at least 90% identical, at least 95% identical, at least 97% identical, or at least 99% identical, to a sequence selected from the group consisting of SEQ ID NO:29-SEQ ID NO:239.

* * * * *